United States Patent 8,481,701 (PROCESS AND METHOD FOR DIAGNOSING ALZHEIMER'S DISEASE) - sequence listing, part 2

SEQ ID NO: 22250 - DNA, 23 bp, Homo sapiens
caggtgagagctgctggcaggtg

SEQ ID NO: 22251 - DNA, 23 bp, Homo sapiens
ctggagcaccagcgtccgagctg

SEQ ID NO: 22252 - DNA, 23 bp, Homo sapiens
acatggtgttgagaaggatgcac

SEQ ID NO: 22253 - DNA, 23 bp, Homo sapiens
aagtggtgctggtgctggagaga

SEQ ID NO: 22254 - DNA, 25 bp, Homo sapiens
agatcctagagcttctgttggaggc

SEQ ID NO: 22255 - DNA, 25 bp, Homo sapiens
agacattcctcagcgacttcctcct

SEQ ID NO: 22256 - DNA, 24 bp, Homo sapiens
gaaagatgaagatgacacccctga

SEQ ID NO: 22257 - DNA, 24 bp, Homo sapiens
agaaagatgaagatgacacccctg

SEQ ID NO: 22258 - DNA, 24 bp, Homo sapiens
gagaaagatgaagatgacacccct

SEQ ID NO: 22259 - DNA, 24 bp, Homo sapiens
ataatgaaaaggcagatgtgttct

SEQ ID NO: 22260 - DNA, 24 bp, Homo sapiens
tataatgaaaaggcagatgtgttc

SEQ ID NO: 22261 - DNA, 24 bp, Homo sapiens
ctataatgaaaaggcagatgtgtt

SEQ ID NO: 22262 - DNA, 24 bp, Homo sapiens
cagaagaaaagtgtcaaaccagaa

SEQ ID NO: 22263 - DNA, 24 bp, Homo sapiens
tcagaagaaaagtgtcaaaccaga

SEQ ID NO: 22264 - DNA, 24 bp, Homo sapiens
atcagaagaaaagtgtcaaaccag

SEQ ID NO: 22265 - DNA, 24 bp, Homo sapiens
cacctccacagttctgtggtccga

SEQ ID NO: 22266 - DNA, 24 bp, Homo sapiens
gcacctccacagttctgtggtccg

SEQ ID NO: 22267 - DNA, 24 bp, Homo sapiens
tgcacctccacagttctgtggtcc

SEQ ID NO: 22268 - DNA, 24 bp, Homo sapiens
gcagtttaaagaaaaatatgatta

SEQ ID NO: 22269 - DNA, 24 bp, Homo sapiens
tgcagtttaaagaaaaatatgatt

SEQ ID NO: 22270 - DNA, 24 bp, Homo sapiens
atgcagtttaaagaaaaatatgat

SEQ ID NO: 22271 - DNA, 24 bp, Homo sapiens
aaccaggagaagaaccatcagaat

SEQ ID NO: 22272 - DNA, 25 bp, Homo sapiens
ctttgggtttgattcacctgctgcg

SEQ ID NO: 22273 - DNA, 25 bp, Homo sapiens
gcagttgtttgtaatgtctagtggg

SEQ ID NO: 22274 - DNA, 23 bp, Homo sapiens
ggagtggcagcgagagcagcaac

SEQ ID NO: 22275 - DNA, 23 bp, Homo sapiens
gctggtggctctggtgctgctgg

SEQ ID NO: 22276 - DNA, 23 bp, Homo sapiens
gcggtcaatgggaaagtcttcga

SEQ ID NO: 22277 - DNA, 25 bp, Homo sapiens
gaatacttgggtgacatctgcctga

SEQ ID NO: 22278 - DNA, 23 bp, Homo sapiens
cggtctggcttgttcgggctcag

SEQ ID NO: 22279 - DNA, 23 bp, Homo sapiens
cgactcttctggaggaagcagcg

SEQ ID NO: 22280 - DNA, 24 bp, Homo sapiens
tgggattacagaagacaaaaatac

SEQ ID NO: 22281 - DNA, 24 bp, Homo sapiens
ctgggattacagaagacaaaaata

SEQ ID NO: 22282 - DNA, 24 bp, Homo sapiens
gctgggattacagaagacaaaaat

SEQ ID NO: 22283 - DNA, 25 bp, Homo sapiens
gaatacttgggtgacatctgcctga

SEQ ID NO: 22284 - DNA, 25 bp, Homo sapiens
ccgcagctcccgatggaaatcatat

SEQ ID NO: 22285 - DNA, 23 bp, Homo sapiens
tggcttgttcgggctcagcggcc

SEQ ID NO: 22286 - DNA, 25 bp, Homo sapiens
gcaatgaatggtcttcggctaggat

SEQ ID NO: 22287 - DNA, 25 bp, Homo sapiens
cgattggaggatgttgcatgacagg

SEQ ID NO: 22288 - DNA, 24 bp, Homo sapiens
cgtcccgctaactggtatgaaccc

SEQ ID NO: 22289 - DNA, 23 bp, Homo sapiens
tttcgtgggcaatgtgtcggctg

SEQ ID NO: 22290 - DNA, 23 bp, Homo sapiens
catgaaacagttcgccttcgtgc

SEQ ID NO: 22291 - DNA, 23 bp, Homo sapiens
caggaaggtggctgcggcgacaa

SEQ ID NO: 22292 - DNA, 24 bp, Homo sapiens
tctcaatctcccgtgggcatctca

SEQ ID NO: 22293 - DNA, 24 bp, Homo sapiens
tccaggccccacctcctcctccat

SEQ ID NO: 22294 - DNA, 24 bp, Homo sapiens
aaatggttgggggaggggcctaga

SEQ ID NO: 22295 - DNA, 24 bp, Homo sapiens
gaagaaacagcagcagcaacagcc

SEQ ID NO: 22296 - DNA, 24 bp, Homo sapiens
gacagtcacctatccaccctctgc

SEQ ID NO: 22297 - DNA, 24 bp, Homo sapiens
tctcaatctcccgtgggcatctca

SEQ ID NO: 22298 - DNA, 24 bp, Homo sapiens
agggggcagagggctgcccctgat

SEQ ID NO: 22299 - DNA, 24 bp, Homo sapiens
gagggggcagagggctgcccctga

SEQ ID NO: 22300 - DNA, 24 bp, Homo sapiens
tgagggggcagagggctgcccctg

SEQ ID NO: 22301 - DNA, 24 bp, Homo sapiens
ggcaaattgagaaacaagaagagt

SEQ ID NO: 22302 - DNA, 24 bp, Homo sapiens
cggcaaattgagaaacaagaagag

SEQ ID NO: 22303 - DNA, 24 bp, Homo sapiens
gcggcaaattgagaaacaagaaga

SEQ ID NO: 22304 - DNA, 24 bp, Homo sapiens
tgttttggcagggcagaaatttag

SEQ ID NO: 22305 - DNA, 24 bp, Homo sapiens
ctgttttggcagggcagaaattta

SEQ ID NO: 22306 - DNA, 24 bp, Homo sapiens
tctgttttggcagggcagaaattt

SEQ ID NO: 22307 - DNA, 24 bp, Homo sapiens
gaagtgcaaggagctgtttcccat

SEQ ID NO: 22308 - DNA, 24 bp, Homo sapiens
ggaagtgcaaggagctgtttccca

SEQ ID NO: 22309 - DNA, 24 bp, Homo sapiens
cggaagtgcaaggagctgtttccc

SEQ ID NO: 22310 - DNA, 24 bp, Homo sapiens
cggcaccagtacgagtcgaagttc

SEQ ID NO: 22311 - DNA, 23 bp, Homo sapiens
ctgccgccacctccgccctcgcc

SEQ ID NO: 22312 - DNA, 23 bp, Homo sapiens
cttcacgctgccgccgctgggag

SEQ ID NO: 22313 - DNA, 24 bp, Homo sapiens
gttttactgaggtaagagttactg

SEQ ID NO: 22314 - DNA, 24 bp, Homo sapiens
cgttttactgaggtaagagttact

SEQ ID NO: 22315 - DNA, 24 bp, Homo sapiens
ccgttttactgaggtaagagttac

SEQ ID NO: 22316 - DNA, 24 bp, Homo sapiens
tcctgacagagacccagcctcgcc

SEQ ID NO: 22317 - DNA, 24 bp, Homo sapiens
ttcctgacagagacccagcctcgc

SEQ ID NO: 22318 - DNA, 24 bp, Homo sapiens
gttcctgacagagacccagcctcg

SEQ ID NO: 22319 - DNA, 23 bp, Homo sapiens
gccaccaccacccagaccttcaa

SEQ ID NO: 22320 - DNA, 25 bp, Homo sapiens
tggaaccttcagccttaacctcact

SEQ ID NO: 22321 - DNA, 25 bp, Homo sapiens
tcatccgacgaaaccttcctcaaag

SEQ ID NO: 22322 - DNA, 24 bp, Homo sapiens
ttggtttatagacatatgaggaag

SEQ ID NO: 22323 - DNA, 24 bp, Homo sapiens
tttggtttatagacatatgaggaa

SEQ ID NO: 22324 - DNA, 24 bp, Homo sapiens
ctttggtttatagacatatgagga

SEQ ID NO: 22325 - DNA, 24 bp, Homo sapiens
tttcacaagagcaacttaaataaa

SEQ ID NO: 22326 - DNA, 24 bp, Homo sapiens
ctttcacaagagcaacttaaataa

SEQ ID NO: 22327 - DNA, 24 bp, Homo sapiens
gctttcacaagagcaacttaaata

SEQ ID NO: 22328 - DNA, 23 bp, Homo sapiens
gactcttactggtcagcagccca

SEQ ID NO: 22329 - DNA, 23 bp, Homo sapiens
gctgtgtggcccagttcctaaca

SEQ ID NO: 22330 - DNA, 23 bp, Homo sapiens
gcaatcctccttcctcagcctcc

SEQ ID NO: 22331 - DNA, 23 bp, Homo sapiens
aggcaggagtacagtggtgctat

SEQ ID NO: 22332 - DNA, 23 bp, Homo sapiens
tcactgcagcctcaacctcctgg

SEQ ID NO: 22333 - DNA, 24 bp, Homo sapiens
gagaatatgatgtgttcttcagat

SEQ ID NO: 22334 - DNA, 24 bp, Homo sapiens
agagaatatgatgtgttcttcaga

SEQ ID NO: 22335 - DNA, 24 bp, Homo sapiens
gagagaatatgatgtgttcttcag

SEQ ID NO: 22336 - DNA, 23 bp, Homo sapiens
aaccatcctcccacctcagcctc

SEQ ID NO: 22337 - DNA, 25 bp, Homo sapiens
tttaatttgttatgtggtgacgggc

SEQ ID NO: 22338 - DNA, 23 bp, Homo sapiens
ggctggaactgcaagcatgaggc

SEQ ID NO: 22339 - DNA, 23 bp, Homo sapiens
cgagagcgtgccactgtactcca

SEQ ID NO: 22340 - DNA, 23 bp, Homo sapiens
gcaacggagacattgtctcaaaa

SEQ ID NO: 22341 - DNA, 24 bp, Homo sapiens
aatatcctaaggaatgaagacacg

SEQ ID NO: 22342 - DNA, 24 bp, Homo sapiens
taatatcctaaggaatgaagacac

SEQ ID NO: 22343 - DNA, 24 bp, Homo sapiens
ttaatatcctaaggaatgaagaca

SEQ ID NO: 22344 - DNA, 24 bp, Homo sapiens
aaaaagaagatgtgaaatcttgtg

SEQ ID NO: 22345 - DNA, 24 bp, Homo sapiens
gaaaaagaagatgtgaaatcttgt

SEQ ID NO: 22346 - DNA, 24 bp, Homo sapiens
agaaaaagaagatgtgaaatcttg

SEQ ID NO: 22347 - DNA, 24 bp, Homo sapiens
taggagcatttgttgctattttct

SEQ ID NO: 22348 - DNA, 24 bp, Homo sapiens
gtaggagcatttgttgctattttc

SEQ ID NO: 22349 - DNA, 24 bp, Homo sapiens
agtaggagcatttgttgctatttt

SEQ ID NO: 22350 - DNA, 24 bp, Homo sapiens
gaactaaacaggttgctattttct

SEQ ID NO: 22351 - DNA, 24 bp, Homo sapiens
agaactaaacaggttgctattttc

SEQ ID NO: 22352 - DNA, 24 bp, Homo sapiens
tagaactaaacaggttgctatttt

SEQ ID NO: 22353 - DNA, 24 bp, Homo sapiens
tttatccacaggtaagtaggtaaa

SEQ ID NO: 22354 - DNA, 24 bp, Homo sapiens
ctttatccacaggtaagtaggtaa

SEQ ID NO: 22355 - DNA, 24 bp, Homo sapiens
cctttatccacaggtaagtaggta

SEQ ID NO: 22356 - DNA, 23 bp, Homo sapiens
gcggtcctcatgcctgtaatccc

SEQ ID NO: 22357 - DNA, 24 bp, Homo sapiens
aggtttaagaaaatccaccctcgg

SEQ ID NO: 22358 - DNA, 23 bp, Homo sapiens
cgggtgttgtgatcgcagtgggc

SEQ ID NO: 22359 - DNA, 23 bp, Homo sapiens
tctcccgcctctgcctgtcactc

SEQ ID NO: 22360 - DNA, 24 bp, Homo sapiens
ggctcaacttcgcagacctcatgg

SEQ ID NO: 22361 - DNA, 24 bp, Homo sapiens
ggctcaacttcgcagacctcatgg

SEQ ID NO: 22362 - DNA, 23 bp, Homo sapiens
ttggaggctacgacaaggtgaag

SEQ ID NO: 22363 - DNA, 23 bp, Homo sapiens
tctcccgcctctgcctgtcactc

SEQ ID NO: 22364 - DNA, 24 bp, Homo sapiens
agaggctgcggtggactgacgccg

SEQ ID NO: 22365 - DNA, 24 bp, Homo sapiens
cagaggctgcggtggactgacgcc

SEQ ID NO: 22366 - DNA, 24 bp, Homo sapiens
acagaggctgcggtggactgacgc

SEQ ID NO: 22367 - DNA, 24 bp, Homo sapiens
gaagtgtgatggattgaaccagct

SEQ ID NO: 22368 - DNA, 24 bp, Homo sapiens
agaagtgtgatggattgaaccagc

SEQ ID NO: 22369 - DNA, 24 bp, Homo sapiens
aagaagtgtgatggattgaaccag

SEQ ID NO: 22370 - DNA, 25 bp, Homo sapiens
ttcttgatgttggctgtggctctgg

SEQ ID NO: 22371 - DNA, 25 bp, Homo sapiens
gtgaagagtaacaacctgacggacc

SEQ ID NO: 22372 - DNA, 23 bp, Homo sapiens
cgggcaaggtggaggaggtgtca

SEQ ID NO: 22373 - DNA, 23 bp, Homo sapiens
gagggtgaggaactgagtgggca

SEQ ID NO: 22374 - DNA, 25 bp, Homo sapiens
ccttgcctgtggaacgaactcattc

SEQ ID NO: 22375 - DNA, 25 bp, Homo sapiens
agatgtggagaactgtgctgtacgg

SEQ ID NO: 22376 - DNA, 23 bp, Homo sapiens
tgctgctactgctgctgctgctc

SEQ ID NO: 22377 - DNA, 25 bp, Homo sapiens
ccctccctctgttgatctctgacct

SEQ ID NO: 22378 - DNA, 23 bp, Homo sapiens
ctggaggatgatgctgtggctgc

SEQ ID NO: 22379 - DNA, 24 bp, Homo sapiens
ccccagggactggacaacctctac

SEQ ID NO: 22380 - DNA, 24 bp, Homo sapiens
cccccagggactggacaacctcta

SEQ ID NO: 22381 - DNA, 24 bp, Homo sapiens
gcccccagggactggacaacctct

SEQ ID NO: 22382 - DNA, 24 bp, Homo sapiens
tgacgacctcaacatccagcgagt

SEQ ID NO: 22383 - DNA, 25 bp, Homo sapiens
acctgaaccactatcccgtgtttgt

SEQ ID NO: 22384 - DNA, 23 bp, Homo sapiens
cctgaggagccgccgccgcttag

SEQ ID NO: 22385 - DNA, 24 bp, Homo sapiens
cttcaaagaagggcaacaggtttg

SEQ ID NO: 22386 - DNA, 24 bp, Homo sapiens
tcttcaaagaagggcaacaggttt

SEQ ID NO: 22387 - DNA, 24 bp, Homo sapiens
gtcttcaaagaagggcaacaggtt

SEQ ID NO: 22388 - DNA, 23 bp, Homo sapiens
cgctcctgctctccgaatgctgc

SEQ ID NO: 22389 - DNA, 23 bp, Homo sapiens
ctgctcctgctgctgctgctcct

SEQ ID NO: 22390 - DNA, 23 bp, Homo sapiens
ctctgaagagcggccattcctca

SEQ ID NO: 22391 - DNA, 24 bp, Homo sapiens
ttgtttttcaggaagctgaagaaa

SEQ ID NO: 22392 - DNA, 24 bp, Homo sapiens
attgtttttcaggaagctgaagaa

SEQ ID NO: 22393 - DNA, 24 bp, Homo sapiens
aattgtttttcaggaagctgaaga

SEQ ID NO: 22394 - DNA, 24 bp, Homo sapiens
caatttatcaggtatgttaatggt

SEQ ID NO: 22395 - DNA, 24 bp, Homo sapiens
gcaatttatcaggtatgttaatgg

SEQ ID NO: 22396 - DNA, 24 bp, Homo sapiens
tgcaatttatcaggtatgttaatg

SEQ ID NO: 22397 - DNA, 23 bp, Homo sapiens
gcctgccgaggagacatgatgtg

SEQ ID NO: 22398 - DNA, 25 bp, Homo sapiens
ccaaactatcccacgatctccaggc

SEQ ID NO: 22399 - DNA, 24 bp, Homo sapiens
atgtgtggatgtggacgagtgtgc

SEQ ID NO: 22400 - DNA, 23 bp, Homo sapiens
ggatcgccagtcaggacagtgtt

SEQ ID NO: 22401 - DNA, 23 bp, Homo sapiens
gcctgccgaggagacatgatgtg

SEQ ID NO: 22402 - DNA, 24 bp, Homo sapiens
atgtgtggatgtggacgagtgtgc

SEQ ID NO: 22403 - DNA, 24 bp, Homo sapiens
gagatcctcctagcccacaggcgg

SEQ ID NO: 22404 - DNA, 24 bp, Homo sapiens
ggagatcctcctagcccacaggcg

SEQ ID NO: 22405 - DNA, 24 bp, Homo sapiens
aggagatcctcctagcccacaggc

SEQ ID NO: 22406 - DNA, 23 bp, Homo sapiens
gctcgctggtgctggtcctgtga

SEQ ID NO: 22407 - DNA, 23 bp, Homo sapiens
ccaaagcactgactgttcacccc

SEQ ID NO: 22408 - DNA, 23 bp, Homo sapiens
ctgtgcccccactgccctccatg

SEQ ID NO: 22409 - DNA, 24 bp, Homo sapiens
ggcagccccgagtaccggcagcgg

SEQ ID NO: 22410 - DNA, 24 bp, Homo sapiens
gcagcagccccaggcagacccccg

SEQ ID NO: 22411 - DNA, 24 bp, Homo sapiens
cagcccaccccgcccacgtcgccg

SEQ ID NO: 22412 - DNA, 24 bp, Homo sapiens
cttggaaagaggtgttgagatctg

SEQ ID NO: 22413 - DNA, 24 bp, Homo sapiens
acttggaaagaggtgttgagatct

SEQ ID NO: 22414 - DNA, 24 bp, Homo sapiens
gacttggaaagaggtgttgagatc

SEQ ID NO: 22415 - DNA, 24 bp, Homo sapiens
cgcagagatggttggccagctatg

SEQ ID NO: 22416 - DNA, 24 bp, Homo sapiens
gcgcagagatggttggccagctat

SEQ ID NO: 22417 - DNA, 24 bp, Homo sapiens
tgcgcagagatggttggccagcta

SEQ ID NO: 22418 - DNA, 25 bp, Homo sapiens
gaaccaactccaattcagtgccagg

SEQ ID NO: 22419 - DNA, 23 bp, Homo sapiens
aacccgtgtttgccttccatcat

SEQ ID NO: 22420 - DNA, 25 bp, Homo sapiens
acgccgaaagaaggagattacagtg

SEQ ID NO: 22421 - DNA, 24 bp, Homo sapiens
gccagcagcagccgccagagcagc

SEQ ID NO: 22422 - DNA, 24 bp, Homo sapiens
ggccagcagcagccgccagagcag

SEQ ID NO: 22423 - DNA, 24 bp, Homo sapiens
gggccagcagcagccgccagagca

SEQ ID NO: 22424 - DNA, 23 bp, Homo sapiens
ctcaagacgcagcacgaggagtt

SEQ ID NO: 22425 - DNA, 23 bp, Homo sapiens
agcagcagcagcagcagcaacag

SEQ ID NO: 22426 - DNA, 24 bp, Homo sapiens
ccgcagatggaggctgaagtcaag

SEQ ID NO: 22427 - DNA, 24 bp, Homo sapiens
gacggtggcagaggcaaagaagaa

SEQ ID NO: 22428 - DNA, 24 bp, Homo sapiens
ggacggtggcagaggcaaagaaga

SEQ ID NO: 22429 - DNA, 24 bp, Homo sapiens
cggacggtggcagaggcaaagaag

SEQ ID NO: 22430 - DNA, 24 bp, Homo sapiens
cttgaatctaggcaatgacattta

SEQ ID NO: 22431 - DNA, 24 bp, Homo sapiens
tcttgaatctaggcaatgacattt

SEQ ID NO: 22432 - DNA, 24 bp, Homo sapiens
ctcttgaatctaggcaatgacatt

SEQ ID NO: 22433 - DNA, 24 bp, Homo sapiens
ttttttgatagctattcaaaatcg

SEQ ID NO: 22434 - DNA, 24 bp, Homo sapiens
attttttgatagctattcaaaatc

SEQ ID NO: 22435 - DNA, 24 bp, Homo sapiens
tattttttgatagctattcaaaat

SEQ ID NO: 22436 - DNA, 24 bp, Homo sapiens
atcataaagagaattctatgagga

SEQ ID NO: 22437 - DNA, 24 bp, Homo sapiens
gatcataaagagaattctatgagg

SEQ ID NO: 22438 - DNA, 24 bp, Homo sapiens
agatcataaagagaattctatgag

SEQ ID NO: 22439 - DNA, 24 bp, Homo sapiens
cactaaaacagattgtcctaaagc

SEQ ID NO: 22440 - DNA, 24 bp, Homo sapiens
tcactaaaacagattgtcctaaag

SEQ ID NO: 22441 - DNA, 24 bp, Homo sapiens
ttcactaaaacagattgtcctaaa

SEQ ID NO: 22442 - DNA, 24 bp, Homo sapiens
gatgttatatgggaggactcagca

SEQ ID NO: 22443 - DNA, 24 bp, Homo sapiens
agatgttatatgggaggactcagc

SEQ ID NO: 22444 - DNA, 24 bp, Homo sapiens
aagatgttatatgggaggactcag

SEQ ID NO: 22445 - DNA, 24 bp, Homo sapiens
cagcggactcctctacctcaacga

SEQ ID NO: 22446 - DNA, 23 bp, Homo sapiens
ggacctgttcttcacggagccca

SEQ ID NO: 22447 - DNA, 24 bp, Homo sapiens
agggagcaggagtggatagaagcc

SEQ ID NO: 22448 - DNA, 24 bp, Homo sapiens
ttattttaaagttggaagctgaag

SEQ ID NO: 22449 - DNA, 24 bp, Homo sapiens
tttattttaaagttggaagctgaa

SEQ ID NO: 22450 - DNA, 24 bp, Homo sapiens
ttttattttaaagttggaagctga

SEQ ID NO: 22451 - DNA, 24 bp, Homo sapiens
tttttaactaggtacatgtgaaga

SEQ ID NO: 22452 - DNA, 24 bp, Homo sapiens
ttttttaactaggtacatgtgaag

SEQ ID NO: 22453 - DNA, 24 bp, Homo sapiens
attttttaactaggtacatgtgaa

SEQ ID NO: 22454 - DNA, 23 bp, Homo sapiens
gccgggcctccagatggagaagg

SEQ ID NO: 22455 - DNA, 23 bp, Homo sapiens
caagccgagcctcacggggtccc

SEQ ID NO: 22456 - DNA, 23 bp, Homo sapiens
aggacccccgcctcgccgaagac

SEQ ID NO: 22457 - DNA, 23 bp, Homo sapiens
cttctgctgccgctactgctgtt

SEQ ID NO: 22458 - DNA, 23 bp, Homo sapiens
cagggctgggagacagaggagag

SEQ ID NO: 22459 - DNA, 24 bp, Homo sapiens
gcgaagaggagtgccacttctacg

SEQ ID NO: 22460 - DNA, 23 bp, Homo sapiens
cctgctcctgctgcgtcgtgagg

SEQ ID NO: 22461 - DNA, 23 bp, Homo sapiens
ggatgctctgatggccgggcctg

SEQ ID NO: 22462 - DNA, 23 bp, Homo sapiens
gcggcggcggcggctgctctggc

SEQ ID NO: 22463 - DNA, 23 bp, Homo sapiens
tggtggcacaatcacgctcactg

SEQ ID NO: 22464 - DNA, 24 bp, Homo sapiens
ttcccacctcagcctcccaagtag

SEQ ID NO: 22465 - DNA, 25 bp, Homo sapiens
gacgagacctctggttgtgaagacg

SEQ ID NO: 22466 - DNA, 24 bp, Homo sapiens
tcctgatgtgctactcctctcgcc

SEQ ID NO: 22467 - DNA, 24 bp, Homo sapiens
agtgatgccttctcgctatgctgc

SEQ ID NO: 22468 - DNA, 23 bp, Homo sapiens
ctgggtgctgttgctgtgtttgc

SEQ ID NO: 22469 - DNA, 24 bp, Homo sapiens
ggtggcgctcgatgaaattaaagc

SEQ ID NO: 22470 - DNA, 24 bp, Homo sapiens
aggtggcgctcgatgaaattaaag

SEQ ID NO: 22471 - DNA, 24 bp, Homo sapiens
caggtggcgctcgatgaaattaaa

SEQ ID NO: 22472 - DNA, 24 bp, Homo sapiens
gcacattgtcagctttcaaggaat

SEQ ID NO: 22473 - DNA, 24 bp, Homo sapiens
ggcacattgtcagctttcaaggaa

SEQ ID NO: 22474 - DNA, 24 bp, Homo sapiens
gggcacattgtcagctttcaagga

SEQ ID NO: 22475 - DNA, 23 bp, Homo sapiens
gcccagcccaaccccgataagta

SEQ ID NO: 22476 - DNA, 25 bp, Homo sapiens
ctgataaaagcaaagagaccaacaa

SEQ ID NO: 22477 - DNA, 23 bp, Homo sapiens
aggggccgcaggtcagcagccca

SEQ ID NO: 22478 - DNA, 24 bp, Homo sapiens
gtgtaaaagagaattccataatta

SEQ ID NO: 22479 - DNA, 24 bp, Homo sapiens
ggtgtaaaagagaattccataatt

SEQ ID NO: 22480 - DNA, 24 bp, Homo sapiens
gggtgtaaaagagaattccataat

SEQ ID NO: 22481 - DNA, 24 bp, Homo sapiens
tctagctcaagattttctccatcc

SEQ ID NO: 22482 - DNA, 24 bp, Homo sapiens
gtctagctcaagattttctccatc

SEQ ID NO: 22483 - DNA, 24 bp, Homo sapiens
tgtctagctcaagattttctccat

SEQ ID NO: 22484 - DNA, 24 bp, Homo sapiens
tggataaaatgattcaagatggaa

SEQ ID NO: 22485 - DNA, 24 bp, Homo sapiens
atggataaaatgattcaagatgga

SEQ ID NO: 22486 - DNA, 24 bp, Homo sapiens
aatggataaaatgattcaagatgg

SEQ ID NO: 22487 - DNA, 23 bp, Homo sapiens
actccaaggtccgcgcagccacc

SEQ ID NO: 22488 - DNA, 23 bp, Homo sapiens
aaaggaagcagcaggacacgccc

SEQ ID NO: 22489 - DNA, 23 bp, Homo sapiens
cctgaccacagagacgcgtccag

SEQ ID NO: 22490 - DNA, 23 bp, Homo sapiens
gacaacactcctgcctcacctcc

SEQ ID NO: 22491 - DNA, 25 bp, Homo sapiens
ctattctgaggacaagagtagttgg

SEQ ID NO: 22492 - DNA, 23 bp, Homo sapiens
ccaaagggctctccgtaaggctg

SEQ ID NO: 22493 - DNA, 24 bp, Homo sapiens
cttttgctcaggcgcttcctccca

SEQ ID NO: 22494 - DNA, 24 bp, Homo sapiens
tcttttgctcaggcgcttcctccc

SEQ ID NO: 22495 - DNA, 24 bp, Homo sapiens
ttcttttgctcaggcgcttcctcc

SEQ ID NO: 22496 - DNA, 24 bp, Homo sapiens
ttaaaccactggtgaatatatgtg

SEQ ID NO: 22497 - DNA, 24 bp, Homo sapiens
cttaaaccactggtgaatatatgt

SEQ ID NO: 22498 - DNA, 24 bp, Homo sapiens
ccttaaaccactggtgaatatatg

SEQ ID NO: 22499 - DNA, 25 bp, Homo sapiens
aactcctagactcaagcaatcctcc

SEQ ID NO: 22500 - DNA, 25 bp, Homo sapiens
tggagtgcagtggtacagtcatagc

SEQ ID NO: 22501 - DNA, 25 bp, Homo sapiens
ttcctgaaatccagcaaacttccga

SEQ ID NO: 22502 - DNA, 24 bp, Homo sapiens
ggggccgaaaggaattaaaggaga

SEQ ID NO: 22503 - DNA, 24 bp, Homo sapiens
tggggccgaaaggaattaaaggag

SEQ ID NO: 22504 - DNA, 24 bp, Homo sapiens
atggggccgaaaggaattaaagga

SEQ ID NO: 22505 - DNA, 23 bp, Homo sapiens
ggtgggtggtgtggagtgccgag

SEQ ID NO: 22506 - DNA, 23 bp, Homo sapiens
cccaaccgtcggcccagtcggac

SEQ ID NO: 22507 - DNA, 23 bp, Homo sapiens
aggcgttgccgggagccgggcgc

SEQ ID NO: 22508 - DNA, 23 bp, Homo sapiens
ccaagaagctgatgcaccaggcg

SEQ ID NO: 22509 - DNA, 25 bp, Homo sapiens
atgactggaggaagatggcagaagc

SEQ ID NO: 22510 - DNA, 24 bp, Homo sapiens
ctttgttgacgagcacacggtttg

SEQ ID NO: 22511 - DNA, 24 bp, Homo sapiens
ttttgttataggaaactggagtta

SEQ ID NO: 22512 - DNA, 24 bp, Homo sapiens
attttgttataggaaactggagtt

SEQ ID NO: 22513 - DNA, 24 bp, Homo sapiens
cattttgttataggaaactggagt

SEQ ID NO: 22514 - DNA, 25 bp, Homo sapiens
aaactgccattcaccatccctgagc

SEQ ID NO: 22515 - DNA, 23 bp, Homo sapiens
ccagatgacactgaccacagagg

SEQ ID NO: 22516 - DNA, 23 bp, Homo sapiens
gaacaccacctaccgccgctact

SEQ ID NO: 22517 - DNA, 24 bp, Homo sapiens
taaagttaaaggtaatgtctgact

SEQ ID NO: 22518 - DNA, 24 bp, Homo sapiens
ataaagttaaaggtaatgtctgac

SEQ ID NO: 22519 - DNA, 24 bp, Homo sapiens
aataaagttaaaggtaatgtctga

SEQ ID NO: 22520 - DNA, 24 bp, Homo sapiens
cacgcctgtaatcccagcactttg

SEQ ID NO: 22521 - DNA, 24 bp, Homo sapiens
aaaattgcttgtaggctgagcgcg

SEQ ID NO: 22522 - DNA, 24 bp, Homo sapiens
attttatcagtaataggtgtcagt

SEQ ID NO: 22523 - DNA, 23 bp, Homo sapiens
ggagaggctggtgtgagtggcgg

SEQ ID NO: 22524 - DNA, 24 bp, Homo sapiens
cagccaatggacaagcagttcctg

SEQ ID NO: 22525 - DNA, 23 bp, Homo sapiens
acgctatcctgtccagtatgccg

SEQ ID NO: 22526 - DNA, 25 bp, Homo sapiens
tcctgtcctatatcaacacatctgc

SEQ ID NO: 22527 - DNA, 23 bp, Homo sapiens
atgtggtggtggctgatgctggc

SEQ ID NO: 22528 - DNA, 24 bp, Homo sapiens
cagacctggcagcactgaatgtgg

SEQ ID NO: 22529 - DNA, 25 bp, Homo sapiens
ccagtggaccaggctatcatatcat

SEQ ID NO: 22530 - DNA, 23 bp, Homo sapiens
gttggtggctgtcctgctctacg

SEQ ID NO: 22531 - DNA, 25 bp, Homo sapiens
cgagaatgaatatgactcaagcccg

SEQ ID NO: 22532 - DNA, 24 bp, Homo sapiens
tggggctgcaggaaggcagcaaca

SEQ ID NO: 22533 - DNA, 24 bp, Homo sapiens
ctggggctgcaggaaggcagcaac

SEQ ID NO: 22534 - DNA, 24 bp, Homo sapiens
gctggggctgcaggaaggcagcaa

SEQ ID NO: 22535 - DNA, 24 bp, Homo sapiens
tctctttgtagaagaaggaagcag

SEQ ID NO: 22536 - DNA, 24 bp, Homo sapiens
ctctctttgtagaagaaggaagca

SEQ ID NO: 22537 - DNA, 24 bp, Homo sapiens
tctctctttgtagaagaaggaagc

SEQ ID NO: 22538 - DNA, 24 bp, Homo sapiens
taaaagcacaggatctgaaaatac

SEQ ID NO: 22539 - DNA, 24 bp, Homo sapiens
ttaaaagcacaggatctgaaaata

SEQ ID NO: 22540 - DNA, 24 bp, Homo sapiens
cttaaaagcacaggatctgaaaat

SEQ ID NO: 22541 - DNA, 24 bp, Homo sapiens
taaccataaaggatctggaaatac

SEQ ID NO: 22542 - DNA, 24 bp, Homo sapiens
ctaaccataaaggatctggaaata

SEQ ID NO: 22543 - DNA, 24 bp, Homo sapiens
tctaaccataaaggatctggaaat

SEQ ID NO: 22544 - DNA, 24 bp, Homo sapiens
taaccacagaggtatataatttct

SEQ ID NO: 22545 - DNA, 24 bp, Homo sapiens
ttaaccacagaggtatataatttc

SEQ ID NO: 22546 - DNA, 24 bp, Homo sapiens
gttaaccacagaggtatataattt

SEQ ID NO: 22547 - DNA, 24 bp, Homo sapiens
ctgttaagtctgtagcagcctcaa

SEQ ID NO: 22548 - DNA, 23 bp, Homo sapiens
tctgtgactggtggagcctggta

SEQ ID NO: 22549 - DNA, 25 bp, Homo sapiens
tgtagaggtgcttaaccaacagtgt

SEQ ID NO: 22550 - DNA, 24 bp, Homo sapiens
actctgtacagtgacactggagag

SEQ ID NO: 22551 - DNA, 24 bp, Homo sapiens
aactctgtacagtgacactggaga

SEQ ID NO: 22552 - DNA, 24 bp, Homo sapiens
aaactctgtacagtgacactggag

SEQ ID NO: 22553 - DNA, 24 bp, Homo sapiens
agttcttggaggagtactgcaagt

SEQ ID NO: 22554 - DNA, 24 bp, Homo sapiens
cagttcttggaggagtactgcaag

SEQ ID NO: 22555 - DNA, 24 bp, Homo sapiens
ccagttcttggaggagtactgcaa

SEQ ID NO: 22556 - DNA, 24 bp, Homo sapiens
agggatcccagcagtgcaaacaga

SEQ ID NO: 22557 - DNA, 24 bp, Homo sapiens
cagggatcccagcagtgcaaacag

SEQ ID NO: 22558 - DNA, 24 bp, Homo sapiens
gcagggatcccagcagtgcaaaca

SEQ ID NO: 22559 - DNA, 24 bp, Homo sapiens
gcagcgtggaggctgtgtgtggtt

SEQ ID NO: 22560 - DNA, 24 bp, Homo sapiens
agcagcgtggaggctgtgtgtggt

SEQ ID NO: 22561 - DNA, 24 bp, Homo sapiens
gagcagcgtggaggctgtgtgtgg

SEQ ID NO: 22562 - DNA, 24 bp, Homo sapiens
ggcagaaggagccagcacaggcca

SEQ ID NO: 22563 - DNA, 24 bp, Homo sapiens
tggcagaaggagccagcacaggcc

SEQ ID NO: 22564 - DNA, 24 bp, Homo sapiens
ctggcagaaggagccagcacaggc

SEQ ID NO: 22565 - DNA, 25 bp, Homo sapiens
cctgacacaacctggagactggaca

SEQ ID NO: 22566 - DNA, 24 bp, Homo sapiens
agcaccttcctcagcctacttgaa

SEQ ID NO: 22567 - DNA, 25 bp, Homo sapiens
gcgagatcatcaagccagcagagaa

SEQ ID NO: 22568 - DNA, 24 bp, Homo sapiens
tccaaattaagcaactaaaattat

SEQ ID NO: 22569 - DNA, 24 bp, Homo sapiens
atccaaattaagcaactaaaatta

SEQ ID NO: 22570 - DNA, 24 bp, Homo sapiens
catccaaattaagcaactaaaatt

SEQ ID NO: 22571 - DNA, 23 bp, Homo sapiens
gtggtggcgatggcttcctgaca

SEQ ID NO: 22572 - DNA, 23 bp, Homo sapiens
aacatgccaacgccgtgaccgag

SEQ ID NO: 22573 - DNA, 24 bp, Homo sapiens
gtgtagtgcctggctccttcatgg

SEQ ID NO: 22574 - DNA, 24 bp, Homo sapiens
tttggtcatagacataagaaacca

SEQ ID NO: 22575 - DNA, 24 bp, Homo sapiens
ttttggtcatagacataagaaacc

SEQ ID NO: 22576 - DNA, 24 bp, Homo sapiens
gttttggtcatagacataagaaac

SEQ ID NO: 22577 - DNA, 23 bp, Homo sapiens
gaagtagcagcagcccactggtg

SEQ ID NO: 22578 - DNA, 23 bp, Homo sapiens
caatcagagtctccgccttggct

SEQ ID NO: 22579 - DNA, 23 bp, Homo sapiens
gattagcacgagttaaacctttg

SEQ ID NO: 22580 - DNA, 23 bp, Homo sapiens
ggctcactgcaacctccgcttcc

SEQ ID NO: 22581 - DNA, 25 bp, Homo sapiens
aagaaatacttttgagtcggtggac

SEQ ID NO: 22582 - DNA, 25 bp, Homo sapiens
gcgcggattcatggaaaatttttaa

SEQ ID NO: 22583 - DNA, 23 bp, Homo sapiens
ggctcactgcaacctccgcttcc

SEQ ID NO: 22584 - DNA, 23 bp, Homo sapiens
gaagccttcgtctcccagattgc

SEQ ID NO: 22585 - DNA, 23 bp, Homo sapiens
agtgggctttgcgagtctgaacg

SEQ ID NO: 22586 - DNA, 24 bp, Homo sapiens
tcggtggactgaacatgactgatg

SEQ ID NO: 22587 - DNA, 23 bp, Homo sapiens
ggctcactgcaacctccgcttcc

SEQ ID NO: 22588 - DNA, 23 bp, Homo sapiens
gaagccttcgtctcccagattgc

SEQ ID NO: 22589 - DNA, 25 bp, Homo sapiens
agatcggcatgaaacgcttgaaggt

SEQ ID NO: 22590 - DNA, 23 bp, Homo sapiens
taagtcccacgagccagcctgtc

SEQ ID NO: 22591 - DNA, 24 bp, Homo sapiens
ggaaggcagaggaggaccacattg

SEQ ID NO: 22592 - DNA, 24 bp, Homo sapiens
ttacactcctgctgacttgaccaa

SEQ ID NO: 22593 - DNA, 23 bp, Homo sapiens
ggtgggtgcggcatcaacctatg

SEQ ID NO: 22594 - DNA, 25 bp, Homo sapiens
attcaatatcgcctgggcatctggg

SEQ ID NO: 22595 - DNA, 24 bp, Homo sapiens
gccacggagaggcaggggaaatgg

SEQ ID NO: 22596 - DNA, 24 bp, Homo sapiens
agccacggagaggcaggggaaatg

SEQ ID NO: 22597 - DNA, 24 bp, Homo sapiens
cagccacggagaggcaggggaaat

SEQ ID NO: 22598 - DNA, 24 bp, Homo sapiens
cacacacacaggtactcgtcctca

SEQ ID NO: 22599 - DNA, 24 bp, Homo sapiens
acacacacacaggtactcgtcctc

SEQ ID NO: 22600 - DNA, 24 bp, Homo sapiens
aacacacacacaggtactcgtcct

SEQ ID NO: 22601 - DNA, 23 bp, Homo sapiens
ggatctcagctcaccgcaacctc

SEQ ID NO: 22602 - DNA, 24 bp, Homo sapiens
ttcagaacaaagtaagtacttata

SEQ ID NO: 22603 - DNA, 24 bp, Homo sapiens
gttcagaacaaagtaagtacttat

SEQ ID NO: 22604 - DNA, 24 bp, Homo sapiens
agttcagaacaaagtaagtactta

SEQ ID NO: 22605 - DNA, 24 bp, Homo sapiens
aagagattacacaccatcaaccaa

SEQ ID NO: 22606 - DNA, 24 bp, Homo sapiens
aaagagattacacaccatcaacca

SEQ ID NO: 22607 - DNA, 24 bp, Homo sapiens
aaaagagattacacaccatcaacc

SEQ ID NO: 22608 - DNA, 24 bp, Homo sapiens
cgccgcagcagttccaggaaggat

SEQ ID NO: 22609 - DNA, 24 bp, Homo sapiens
gcgccgcagcagttccaggaagga

SEQ ID NO: 22610 - DNA, 24 bp, Homo sapiens
ggcgccgcagcagttccaggaagg

SEQ ID NO: 22611 - DNA, 24 bp, Homo sapiens
aatttcaactggattatattccat

SEQ ID NO: 22612 - DNA, 24 bp, Homo sapiens
gaatttcaactggattatattcca

SEQ ID NO: 22613 - DNA, 24 bp, Homo sapiens
agaatttcaactggattatattcc

SEQ ID NO: 22614 - DNA, 24 bp, Homo sapiens
aacagtgtccggtactaccccagt

SEQ ID NO: 22615 - DNA, 24 bp, Homo sapiens
caacagtgtccggtactaccccag

SEQ ID NO: 22616 - DNA, 24 bp, Homo sapiens
tcaacagtgtccggtactacccca

SEQ ID NO: 22617 - DNA, 24 bp, Homo sapiens
tctttttaaaggtaagaataaaat

SEQ ID NO: 22618 - DNA, 24 bp, Homo sapiens
atctttttaaaggtaagaataaaa

SEQ ID NO: 22619 - DNA, 24 bp, Homo sapiens
tatctttttaaaggtaagaataaa

SEQ ID NO: 22620 - DNA, 25 bp, Homo sapiens
tcttctcgctcctatgattcctgcc

SEQ ID NO: 22621 - DNA, 25 bp, Homo sapiens
gggactcagactggctttcttgctc

SEQ ID NO: 22622 - DNA, 23 bp, Homo sapiens
ggcaggaccaggcaccagagctg

SEQ ID NO: 22623 - DNA, 24 bp, Homo sapiens
ttgttgcccaggcagaggttgcag

SEQ ID NO: 22624 - DNA, 24 bp, Homo sapiens
cttgttgcccaggcagaggttgca

SEQ ID NO: 22625 - DNA, 24 bp, Homo sapiens
tcttgttgcccaggcagaggttgc

SEQ ID NO: 22626 - DNA, 24 bp, Homo sapiens
atgaattaaaggtaatggtatact

SEQ ID NO: 22627 - DNA, 24 bp, Homo sapiens
catgaattaaaggtaatggtatac

SEQ ID NO: 22628 - DNA, 24 bp, Homo sapiens
tcatgaattaaaggtaatggtata

SEQ ID NO: 22629 - DNA, 24 bp, Homo sapiens
gggttgcacaagctgggtattgat

SEQ ID NO: 22630 - DNA, 24 bp, Homo sapiens
tgggttgcacaagctgggtattga

SEQ ID NO: 22631 - DNA, 24 bp, Homo sapiens
atgggttgcacaagctgggtattg

SEQ ID NO: 22632 - DNA, 23 bp, Homo sapiens
gccaccacctcctcctcctcctg

SEQ ID NO: 22633 - DNA, 23 bp, Homo sapiens
ctgctccaggctctaggactgcg

SEQ ID NO: 22634 - DNA, 23 bp, Homo sapiens
cactctctggtcatcgcctggga

SEQ ID NO: 22635 - DNA, 25 bp, Homo sapiens
tcactggcaacttcaagactcactg

SEQ ID NO: 22636 - DNA, 23 bp, Homo sapiens
ctgacctcgtgatccgcctacct

SEQ ID NO: 22637 - DNA, 23 bp, Homo sapiens
acagtgtctccaggcagggtact

SEQ ID NO: 22638 - DNA, 24 bp, Homo sapiens
tcttctttcagataatagttggtg

SEQ ID NO: 22639 - DNA, 24 bp, Homo sapiens
atcttctttcagataatagttggt

SEQ ID NO: 22640 - DNA, 24 bp, Homo sapiens
tatcttctttcagataatagttgg

SEQ ID NO: 22641 - DNA, 24 bp, Homo sapiens
tgtttatgcagggatgattacagt

SEQ ID NO: 22642 - DNA, 24 bp, Homo sapiens
ctgtttatgcagggatgattacag

SEQ ID NO: 22643 - DNA, 24 bp, Homo sapiens
gctgtttatgcagggatgattaca

SEQ ID NO: 22644 - DNA, 24 bp, Homo sapiens
cctttcaaaaggtaagaaaatacc

SEQ ID NO: 22645 - DNA, 24 bp, Homo sapiens
gcctttcaaaaggtaagaaaatac

SEQ ID NO: 22646 - DNA, 24 bp, Homo sapiens
tgcctttcaaaaggtaagaaaata

SEQ ID NO: 22647 - DNA, 23 bp, Homo sapiens
ggtgctggtgatgctgaacctgg

SEQ ID NO: 22648 - DNA, 25 bp, Homo sapiens
tgttcatctgctcctggtactacgc

SEQ ID NO: 22649 - DNA, 25 bp, Homo sapiens
ctttctgggtatgagcctgtgcctg

SEQ ID NO: 22650 - DNA, 24 bp, Homo sapiens
aatatgagatagagttcatctatg

SEQ ID NO: 22651 - DNA, 24 bp, Homo sapiens
gaatatgagatagagttcatctat

SEQ ID NO: 22652 - DNA, 24 bp, Homo sapiens
agaatatgagatagagttcatcta

SEQ ID NO: 22653 - DNA, 24 bp, Homo sapiens
tatttcatcagaatcatcttattg

SEQ ID NO: 22654 - DNA, 24 bp, Homo sapiens
ctatttcatcagaatcatcttatt

SEQ ID NO: 22655 - DNA, 24 bp, Homo sapiens
actatttcatcagaatcatcttat

SEQ ID NO: 22656 - DNA, 24 bp, Homo sapiens
ctttgccccagaaaaaggatgcag

SEQ ID NO: 22657 - DNA, 24 bp, Homo sapiens
tctttgccccagaaaaaggatgca

SEQ ID NO: 22658 - DNA, 24 bp, Homo sapiens
ctctttgccccagaaaaaggatgc

SEQ ID NO: 22659 - DNA, 25 bp, Homo sapiens
caataagatggagtggtggagccgc

SEQ ID NO: 22660 - DNA, 23 bp, Homo sapiens
tgaggacggcaaggtggtgactg

SEQ ID NO: 22661 - DNA, 25 bp, Homo sapiens
caatgaagtgaaggtggaggagagc

SEQ ID NO: 22662 - DNA, 24 bp, Homo sapiens
gttttatgatggggtaaaaataca

SEQ ID NO: 22663 - DNA, 24 bp, Homo sapiens
ggttttatgatggggtaaaaatac

SEQ ID NO: 22664 - DNA, 24 bp, Homo sapiens
tggttttatgatggggtaaaaata

SEQ ID NO: 22665 - DNA, 24 bp, Homo sapiens
ctcttcaccagccgcttcaaggac

SEQ ID NO: 22666 - DNA, 25 bp, Homo sapiens
agagtatgatgtggcagtggaggct

SEQ ID NO: 22667 - DNA, 25 bp, Homo sapiens
gagcgtctacccagttgtgtatgcc

SEQ ID NO: 22668 - DNA, 24 bp, Homo sapiens
aatctactacagtaagtaaattat

SEQ ID NO: 22669 - DNA, 24 bp, Homo sapiens
taatctactacagtaagtaaatta

SEQ ID NO: 22670 - DNA, 24 bp, Homo sapiens
ttaatctactacagtaagtaaatt

SEQ ID NO: 22671 - DNA, 24 bp, Homo sapiens
aaaagaacagtgtatgtatttgct

SEQ ID NO: 22672 - DNA, 24 bp, Homo sapiens
caaaagaacagtgtatgtatttgc

SEQ ID NO: 22673 - DNA, 24 bp, Homo sapiens
acaaaagaacagtgtatgtatttg

SEQ ID NO: 22674 - DNA, 24 bp, Homo sapiens
gcaaaggcaaaacttgtaaaaaag

SEQ ID NO: 22675 - DNA, 24 bp, Homo sapiens
ggcaaaggcaaaacttgtaaaaaa

SEQ ID NO: 22676 - DNA, 24 bp, Homo sapiens
aggcaaaggcaaaacttgtaaaaa

SEQ ID NO: 22677 - DNA, 25 bp, Homo sapiens
tgacattgaggtgttccagaagatg

SEQ ID NO: 22678 - DNA, 25 bp, Homo sapiens
tgatagcagctccagaaataccaac

SEQ ID NO: 22679 - DNA, 24 bp, Homo sapiens
aggcaagccaccattttacccacg

SEQ ID NO: 22680 - DNA, 24 bp, Homo sapiens
cgaagaagaagaaaattacgaaaa

SEQ ID NO: 22681 - DNA, 24 bp, Homo sapiens
tcgaagaagaagaaaattacgaaa

SEQ ID NO: 22682 - DNA, 24 bp, Homo sapiens
atcgaagaagaagaaaattacgaa

SEQ ID NO: 22683 - DNA, 23 bp, Homo sapiens
gaccaccactgccacaaccacct

SEQ ID NO: 22684 - DNA, 24 bp, Homo sapiens
gaggacattgacgagtgccaggtg

SEQ ID NO: 22685 - DNA, 25 bp, Homo sapiens
taccttccgctccgactactccaac

SEQ ID NO: 22686 - DNA, 23 bp, Homo sapiens
gcgtgcagcattgttgactgtgg

SEQ ID NO: 22687 - DNA, 24 bp, Homo sapiens
gccgagtggagtacatcacaggtc

SEQ ID NO: 22688 - DNA, 25 bp, Homo sapiens
gtgtgaggctgatggattctggacg

SEQ ID NO: 22689 - DNA, 24 bp, Homo sapiens
gcaaaatacaggcaaattctctga

SEQ ID NO: 22690 - DNA, 24 bp, Homo sapiens
tgcaaaatacaggcaaattctctg

SEQ ID NO: 22691 - DNA, 24 bp, Homo sapiens
ttgcaaaatacaggcaaattctct

SEQ ID NO: 22692 - DNA, 24 bp, Homo sapiens
ccaaggcaccaggaccagccacat

SEQ ID NO: 22693 - DNA, 24 bp, Homo sapiens
tccaaggcaccaggaccagccaca

SEQ ID NO: 22694 - DNA, 24 bp, Homo sapiens
ttccaaggcaccaggaccagccac

SEQ ID NO: 22695 - DNA, 24 bp, Homo sapiens
tttctgcaaaaggaaagtctttat

SEQ ID NO: 22696 - DNA, 24 bp, Homo sapiens
ctttctgcaaaaggaaagtcttta

SEQ ID NO: 22697 - DNA, 24 bp, Homo sapiens
cctttctgcaaaaggaaagtcttt

SEQ ID NO: 22698 - DNA, 24 bp, Homo sapiens
tactccaaaaagtgtaaactgttt

SEQ ID NO: 22699 - DNA, 24 bp, Homo sapiens
ttactccaaaaagtgtaaactgtt

SEQ ID NO: 22700 - DNA, 24 bp, Homo sapiens
tttactccaaaaagtgtaaactgt

SEQ ID NO: 22701 - DNA, 24 bp, Homo sapiens
cctcaccaccatcaccaccattcg

SEQ ID NO: 22702 - DNA, 23 bp, Homo sapiens
caaagtgctgggaaagggtggct

SEQ ID NO: 22703 - DNA, 25 bp, Homo sapiens
acaaataacaaagtctacgccgcaa

SEQ ID NO: 22704 - DNA, 24 bp, Homo sapiens
cgtattacaaagtaagtaaattta

SEQ ID NO: 22705 - DNA, 24 bp, Homo sapiens
ccgtattacaaagtaagtaaattt

SEQ ID NO: 22706 - DNA, 24 bp, Homo sapiens
accgtattacaaagtaagtaaatt

SEQ ID NO: 22707 - DNA, 24 bp, Homo sapiens
ggtccaagtcccagcccaagaaag

SEQ ID NO: 22708 - DNA, 24 bp, Homo sapiens
tttcaagatctaaatccaattcaa

SEQ ID NO: 22709 - DNA, 24 bp, Homo sapiens
acagcaagcaggttaccagccagt

SEQ ID NO: 22710 - DNA, 24 bp, Homo sapiens
cacagcaagcaggttaccagccag

SEQ ID NO: 22711 - DNA, 24 bp, Homo sapiens
gcacagcaagcaggttaccagcca

SEQ ID NO: 22712 - DNA, 24 bp, Homo sapiens
aataattccagggacaggatgata

SEQ ID NO: 22713 - DNA, 24 bp, Homo sapiens
gaataattccagggacaggatgat

SEQ ID NO: 22714 - DNA, 24 bp, Homo sapiens
agaataattccagggacaggatga

SEQ ID NO: 22715 - DNA, 24 bp, Homo sapiens
ttccagcctgcaagaggaggataa

SEQ ID NO: 22716 - DNA, 23 bp, Homo sapiens
gaaagatgactctgaaagagaaa

SEQ ID NO: 22717 - DNA, 25 bp, Homo sapiens
aaacccaagatcagaatgttatcaa

SEQ ID NO: 22718 - DNA, 23 bp, Homo sapiens
agcaggttccgagtcttccagca

SEQ ID NO: 22719 - DNA, 23 bp, Homo sapiens
aacagcagccaccacagcagcag

SEQ ID NO: 22720 - DNA, 24 bp, Homo sapiens
ccatccacctctccagagcacacc

SEQ ID NO: 22721 - DNA, 23 bp, Homo sapiens
aacagcagccaccacagcagcag

SEQ ID NO: 22722 - DNA, 23 bp, Homo sapiens
tccagccaccgcagccacagatg

SEQ ID NO: 22723 - DNA, 25 bp, Homo sapiens
gcaatatacaacccacccaccagtc

SEQ ID NO: 22724 - DNA, 24 bp, Homo sapiens
ctgtcatattggtgagggtttgcc

SEQ ID NO: 22725 - DNA, 24 bp, Homo sapiens
cctgtcatattggtgagggtttgc

SEQ ID NO: 22726 - DNA, 24 bp, Homo sapiens
gcctgtcatattggtgagggtttg

SEQ ID NO: 22727 - DNA, 24 bp, Homo sapiens
caaggccaagggtgaaaaccattc

SEQ ID NO: 22728 - DNA, 24 bp, Homo sapiens
acaaggccaagggtgaaaaccatt

SEQ ID NO: 22729 - DNA, 24 bp, Homo sapiens
cacaaggccaagggtgaaaaccat

SEQ ID NO: 22730 - DNA, 24 bp, Homo sapiens
tccatattttggtatgttgtaatt

SEQ ID NO: 22731 - DNA, 24 bp, Homo sapiens
ctccatattttggtatgttgtaat

SEQ ID NO: 22732 - DNA, 24 bp, Homo sapiens
tctccatattttggtatgttgtaa

SEQ ID NO: 22733 - DNA, 24 bp, Homo sapiens
gtggattatctttggctttatttt

SEQ ID NO: 22734 - DNA, 24 bp, Homo sapiens
agtggattatctttggctttattt

SEQ ID NO: 22735 - DNA, 24 bp, Homo sapiens
aagtggattatctttggctttatt

SEQ ID NO: 22736 - DNA, 24 bp, Homo sapiens
ttaaaaagaaagtttaagaatgtt

SEQ ID NO: 22737 - DNA, 24 bp, Homo sapiens
cttaaaaagaaagtttaagaatgt

SEQ ID NO: 22738 - DNA, 24 bp, Homo sapiens
acttaaaaagaaagtttaagaatg

SEQ ID NO: 22739 - DNA, 24 bp, Homo sapiens
tttataagaaggtaatacttcctt

SEQ ID NO: 22740 - DNA, 24 bp, Homo sapiens
atttataagaaggtaatacttcct

SEQ ID NO: 22741 - DNA, 24 bp, Homo sapiens
gatttataagaaggtaatacttcc

SEQ ID NO: 22742 - DNA, 24 bp, Homo sapiens
ttgcagatgagaacataccaaata

SEQ ID NO: 22743 - DNA, 24 bp, Homo sapiens
gttgcagatgagaacataccaaat

SEQ ID NO: 22744 - DNA, 24 bp, Homo sapiens
agttgcagatgagaacataccaaa

SEQ ID NO: 22745 - DNA, 24 bp, Homo sapiens
ccggatctcagccttgaaaagatc

SEQ ID NO: 22746 - DNA, 24 bp, Homo sapiens
accggatctcagccttgaaaagat

SEQ ID NO: 22747 - DNA, 24 bp, Homo sapiens
gaccggatctcagccttgaaaaga

SEQ ID NO: 22748 - DNA, 24 bp, Homo sapiens
cccgtgtgtatttcaggaggctgc

SEQ ID NO: 22749 - DNA, 23 bp, Homo sapiens
gccccacgcagcctccgactcac

SEQ ID NO: 22750 - DNA, 24 bp, Homo sapiens
tgacaaaactgaaaatgaacagta

SEQ ID NO: 22751 - DNA, 24 bp, Homo sapiens
atgacaaaactgaaaatgaacagt

SEQ ID NO: 22752 - DNA, 24 bp, Homo sapiens
catgacaaaactgaaaatgaacag

SEQ ID NO: 22753 - DNA, 24 bp, Homo sapiens
ccaaaaatcaggtatgttctttaa

SEQ ID NO: 22754 - DNA, 24 bp, Homo sapiens
gccaaaaatcaggtatgttcttta

SEQ ID NO: 22755 - DNA, 24 bp, Homo sapiens
agccaaaaatcaggtatgttcttt

SEQ ID NO: 22756 - DNA, 25 bp, Homo sapiens
ggctgtctgtgtgtccttctgagtg

SEQ ID NO: 22757 - DNA, 24 bp, Homo sapiens
ccagggtttcttatcagccagccg

SEQ ID NO: 22758 - DNA, 23 bp, Homo sapiens
cagagtgaggcaggcaacccgag

SEQ ID NO: 22759 - DNA, 23 bp, Homo sapiens
ctgtcaccgtgcagtgcgccttc

SEQ ID NO: 22760 - DNA, 23 bp, Homo sapiens
ccctgagggcacgaagaggagcc

SEQ ID NO: 22761 - DNA, 23 bp, Homo sapiens
cctccctcaccaggcccagcttg

SEQ ID NO: 22762 - DNA, 23 bp, Homo sapiens
actgtggaagcagagcaatcgcc

SEQ ID NO: 22763 - DNA, 25 bp, Homo sapiens
gccatacttgcgtgtgagttctgac

SEQ ID NO: 22764 - DNA, 23 bp, Homo sapiens
cttcagccgccgccgcagctcac

SEQ ID NO: 22765 - DNA, 24 bp, Homo sapiens
ggacgcaccaaggatggagatgtt

SEQ ID NO: 22766 - DNA, 24 bp, Homo sapiens
gctgctgctgttgctgctgctgag

SEQ ID NO: 22767 - DNA, 24 bp, Homo sapiens
ctggctgtggagaaggagggctgc

SEQ ID NO: 22768 - DNA, 23 bp, Homo sapiens
cagcagagccgcagcagcaacag

SEQ ID NO: 22769 - DNA, 25 bp, Homo sapiens
gggctgaaagggaagagaacttaga

SEQ ID NO: 22770 - DNA, 23 bp, Homo sapiens
ctgtgcaaggacctcagcagctt

SEQ ID NO: 22771 - DNA, 24 bp, Homo sapiens
actctttcccagatgacaattgtg

SEQ ID NO: 22772 - DNA, 24 bp, Homo sapiens
aactctttcccagatgacaattgt

SEQ ID NO: 22773 - DNA, 24 bp, Homo sapiens
aaactctttcccagatgacaattg

SEQ ID NO: 22774 - DNA, 24 bp, Homo sapiens
tatttctagaggttagtaattgtt

SEQ ID NO: 22775 - DNA, 24 bp, Homo sapiens
gtatttctagaggttagtaattgt

SEQ ID NO: 22776 - DNA, 24 bp, Homo sapiens
agtatttctagaggttagtaattg

SEQ ID NO: 22777 - DNA, 24 bp, Homo sapiens
cactatctcaggtgaaatctatcc

SEQ ID NO: 22778 - DNA, 24 bp, Homo sapiens
acactatctcaggtgaaatctatc

SEQ ID NO: 22779 - DNA, 24 bp, Homo sapiens
tacactatctcaggtgaaatctat

SEQ ID NO: 22780 - DNA, 24 bp, Homo sapiens
agtacctgcgggtcaagacagtga

SEQ ID NO: 22781 - DNA, 24 bp, Homo sapiens
tttgtgagaagaaagtccctgccc

SEQ ID NO: 22782 - DNA, 23 bp, Homo sapiens
ctcctgcctgcacaccatgtctg

SEQ ID NO: 22783 - DNA, 23 bp, Homo sapiens
acctggatgagaagaacctggct

SEQ ID NO: 22784 - DNA, 23 bp, Homo sapiens
tacgaggagacctgccgagaagc

SEQ ID NO: 22785 - DNA, 23 bp, Homo sapiens
ctgaaggctctgctggatgcggc

SEQ ID NO: 22786 - DNA, 23 bp, Homo sapiens
gagcgaggcctgggcagcaagtc

SEQ ID NO: 22787 - DNA, 23 bp, Homo sapiens
ccttcgtgggggaggtgggtgcc

SEQ ID NO: 22788 - DNA, 23 bp, Homo sapiens
cccccgggggcggctcggtggcg

SEQ ID NO: 22789 - DNA, 24 bp, Homo sapiens
aaaatgaaaagtgtgaactgaatg

SEQ ID NO: 22790 - DNA, 24 bp, Homo sapiens
aaaaatgaaaagtgtgaactgaat

SEQ ID NO: 22791 - DNA, 24 bp, Homo sapiens
gaaaaatgaaaagtgtgaactgaa

SEQ ID NO: 22792 - DNA, 24 bp, Homo sapiens
attttttccctagttggaagggca

SEQ ID NO: 22793 - DNA, 24 bp, Homo sapiens
tattttttccctagttggaagggc

SEQ ID NO: 22794 - DNA, 24 bp, Homo sapiens
gtattttttccctagttggaaggg

SEQ ID NO: 22795 - DNA, 24 bp, Homo sapiens
acatttaacaggtgagtagaggac

SEQ ID NO: 22796 - DNA, 24 bp, Homo sapiens
aacatttaacaggtgagtagagga

SEQ ID NO: 22797 - DNA, 24 bp, Homo sapiens
caacatttaacaggtgagtagagg

SEQ ID NO: 22798 - DNA, 24 bp, Homo sapiens
atcaggtgcaggtatgcagaggcc

SEQ ID NO: 22799 - DNA, 24 bp, Homo sapiens
catcaggtgcaggtatgcagaggc

SEQ ID NO: 22800 - DNA, 24 bp, Homo sapiens
acatcaggtgcaggtatgcagagg

SEQ ID NO: 22801 - DNA, 25 bp, Homo sapiens
ttccaagaaccatcagccttacagc

SEQ ID NO: 22802 - DNA, 23 bp, Homo sapiens
gaggcaggcggatcacttgaggc

SEQ ID NO: 22803 - DNA, 25 bp, Homo sapiens
gcattctgttgactctgacacttcc

SEQ ID NO: 22804 - DNA, 23 bp, Homo sapiens
ggactatttgtgcgaagagatgc

SEQ ID NO: 22805 - DNA, 24 bp, Homo sapiens
ctctgctgactttgctcaggagcg

SEQ ID NO: 22806 - DNA, 23 bp, Homo sapiens
ccagagccccctcgccccaaagg

SEQ ID NO: 22807 - DNA, 24 bp, Homo sapiens
gccttcgagaagtgcgacccttac

SEQ ID NO: 22808 - DNA, 23 bp, Homo sapiens
gcgtcgtgcaacgacacagtcat

SEQ ID NO: 22809 - DNA, 23 bp, Homo sapiens
tcgccaccacgctcagcgacggc

SEQ ID NO: 22810 - DNA, 24 bp, Homo sapiens
cctcgttcctgtccgtcaccattg

SEQ ID NO: 22811 - DNA, 23 bp, Homo sapiens
cgtcgtggacctggacttcttca

SEQ ID NO: 22812 - DNA, 23 bp, Homo sapiens
gccgctgatgctgctgctcctgg

SEQ ID NO: 22813 - DNA, 23 bp, Homo sapiens
gctggcgtggtgctggagatgat

SEQ ID NO: 22814 - DNA, 23 bp, Homo sapiens
gacacgccattcacagccatcgc

SEQ ID NO: 22815 - DNA, 23 bp, Homo sapiens
ctggagatgagcaagaccgaggc

SEQ ID NO: 22816 - DNA, 25 bp, Homo sapiens
atcatccctggagtgctgttcatcg

SEQ ID NO: 22817 - DNA, 25 bp, Homo sapiens
atcaagtcagaagtccgtgagcaga

SEQ ID NO: 22818 - DNA, 23 bp, Homo sapiens
cgtcatcaactctcgcacccagg

SEQ ID NO: 22819 - DNA, 24 bp, Homo sapiens
ctgttactatggtagcgacactgc

SEQ ID NO: 22820 - DNA, 23 bp, Homo sapiens
tggtggtgacaggagcctacatc

SEQ ID NO: 22821 - DNA, 24 bp, Homo sapiens
ccgtggtgaactcaggagggaatg

SEQ ID NO: 22822 - DNA, 24 bp, Homo sapiens
ctctgttgcagtaagtgctataaa

SEQ ID NO: 22823 - DNA, 24 bp, Homo sapiens
tctctgttgcagtaagtgctataa

SEQ ID NO: 22824 - DNA, 24 bp, Homo sapiens
ctctctgttgcagtaagtgctata

SEQ ID NO: 22825 - DNA, 23 bp, Homo sapiens
tggaatgtcggtggaggcagtct

SEQ ID NO: 22826 - DNA, 25 bp, Homo sapiens
ctggcgtgaatcgttgggaggttta

SEQ ID NO: 22827 - DNA, 23 bp, Homo sapiens
ggtctggagaggaggagctggtg

SEQ ID NO: 22828 - DNA, 25 bp, Homo sapiens
accttcatacctagacctgttccgc

SEQ ID NO: 22829 - DNA, 23 bp, Homo sapiens
cgtggtggtgtggttcggagtga

SEQ ID NO: 22830 - DNA, 23 bp, Homo sapiens
ctgctggtctacttgtcggtgcg

SEQ ID NO: 22831 - DNA, 24 bp, Homo sapiens
ggaagaacgtgtacgacgagctgg

SEQ ID NO: 22832 - DNA, 23 bp, Homo sapiens
ccaggcagcaccagcgcggccac

SEQ ID NO: 22833 - DNA, 24 bp, Homo sapiens
tgcgagtgcaggctccttgccaga

SEQ ID NO: 22834 - DNA, 24 bp, Homo sapiens
ttgcgagtgcaggctccttgccag

SEQ ID NO: 22835 - DNA, 24 bp, Homo sapiens
gttgcgagtgcaggctccttgcca

SEQ ID NO: 22836 - DNA, 24 bp, Homo sapiens
cagtgacgtgggctggcgcttgtt

SEQ ID NO: 22837 - DNA, 24 bp, Homo sapiens
gcagtgacgtgggctggcgcttgt

SEQ ID NO: 22838 - DNA, 24 bp, Homo sapiens
cgcagtgacgtgggctggcgcttg

SEQ ID NO: 22839 - DNA, 23 bp, Homo sapiens
tcctgctgctgctgctgctgctc

SEQ ID NO: 22840 - DNA, 23 bp, Homo sapiens
gccgagatgctgcgaacagagag

SEQ ID NO: 22841 - DNA, 23 bp, Homo sapiens
cagcgtccctagcaccgagcctc

SEQ ID NO: 22842 - DNA, 25 bp, Homo sapiens
ctgatcctaccctccctactcctgc

SEQ ID NO: 22843 - DNA, 24 bp, Homo sapiens
tgccaccaccaccacaaaagacac

SEQ ID NO: 22844 - DNA, 25 bp, Homo sapiens
ccttgtaactactgcttctgctacc

SEQ ID NO: 22845 - DNA, 24 bp, Homo sapiens
tcttgccctaggtatctggctatt

SEQ ID NO: 22846 - DNA, 24 bp, Homo sapiens
ttcttgccctaggtatctggctat

SEQ ID NO: 22847 - DNA, 24 bp, Homo sapiens
gttcttgccctaggtatctggcta

SEQ ID NO: 22848 - DNA, 24 bp, Homo sapiens
ttccaccataggagcaaaactgaa

SEQ ID NO: 22849 - DNA, 24 bp, Homo sapiens
tttccaccataggagcaaaactga

SEQ ID NO: 22850 - DNA, 24 bp, Homo sapiens
atttccaccataggagcaaaactg

SEQ ID NO: 22851 - DNA, 23 bp, Homo sapiens
cggcacacacggagagtcatctg

SEQ ID NO: 22852 - DNA, 24 bp, Homo sapiens
ggagtgcagcaacaaggaatgtcc

SEQ ID NO: 22853 - DNA, 24 bp, Homo sapiens
atgaccaagatgcccgagtgctac

SEQ ID NO: 22854 - DNA, 24 bp, Homo sapiens
aaattaaagagatgatgaaacatg

SEQ ID NO: 22855 - DNA, 24 bp, Homo sapiens
aaaattaaagagatgatgaaacat

SEQ ID NO: 22856 - DNA, 24 bp, Homo sapiens
aaaaattaaagagatgatgaaaca

SEQ ID NO: 22857 - DNA, 24 bp, Homo sapiens
actacaaaaaggttatgcacattc

SEQ ID NO: 22858 - DNA, 24 bp, Homo sapiens
tactacaaaaaggttatgcacatt

SEQ ID NO: 22859 - DNA, 24 bp, Homo sapiens
ttactacaaaaaggttatgcacat

SEQ ID NO: 22860 - DNA, 24 bp, Homo sapiens
atgctattgaggctatagaaaaac

SEQ ID NO: 22861 - DNA, 24 bp, Homo sapiens
gatgctattgaggctatagaaaaa

SEQ ID NO: 22862 - DNA, 24 bp, Homo sapiens
tgatgctattgaggctatagaaaa

SEQ ID NO: 22863 - DNA, 24 bp, Homo sapiens
agaagcatgagttgaagaacaaga

SEQ ID NO: 22864 - DNA, 24 bp, Homo sapiens
aagaagcatgagttgaagaacaag

SEQ ID NO: 22865 - DNA, 24 bp, Homo sapiens
aaagaagcatgagttgaagaacaa

SEQ ID NO: 22866 - DNA, 23 bp, Homo sapiens
ccagtgatgctctgtgccataga

SEQ ID NO: 22867 - DNA, 23 bp, Homo sapiens
aagcccacgccaccccaagcatc

SEQ ID NO: 22868 - DNA, 25 bp, Homo sapiens
acgtgatagtaaatccccggcaaaa

SEQ ID NO: 22869 - DNA, 23 bp, Homo sapiens
aagcccacgccaccccaagcatc

SEQ ID NO: 22870 - DNA, 23 bp, Homo sapiens
tcccggagtcccagtgatgctct

SEQ ID NO: 22871 - DNA, 25 bp, Homo sapiens
gagcccccataacttcactactacg

SEQ ID NO: 22872 - DNA, 24 bp, Homo sapiens
ctgagaaaaggaatatgtgaatac

SEQ ID NO: 22873 - DNA, 24 bp, Homo sapiens
gctgagaaaaggaatatgtgaata

SEQ ID NO: 22874 - DNA, 24 bp, Homo sapiens
tgctgagaaaaggaatatgtgaat

SEQ ID NO: 22875 - DNA, 23 bp, Homo sapiens
cttctgtgtgctggctgcgggtg

SEQ ID NO: 22876 - DNA, 25 bp, Homo sapiens
ttacgctgatccaggctttctgctg

SEQ ID NO: 22877 - DNA, 23 bp, Homo sapiens
atgtgcagcggctggcggctatc

SEQ ID NO: 22878 - DNA, 24 bp, Homo sapiens
agtcagccgggattcaaagccgga

SEQ ID NO: 22879 - DNA, 24 bp, Homo sapiens
aagtcagccgggattcaaagccgg

SEQ ID NO: 22880 - DNA, 24 bp, Homo sapiens
caagtcagccgggattcaaagccg

SEQ ID NO: 22881 - DNA, 24 bp, Homo sapiens
tttatcaacaggattttaattttg

SEQ ID NO: 22882 - DNA, 24 bp, Homo sapiens
ttttatcaacaggattttaatttt

SEQ ID NO: 22883 - DNA, 24 bp, Homo sapiens
gttttatcaacaggattttaattt

SEQ ID NO: 22884 - DNA, 24 bp, Homo sapiens
gcatacaaaaggtaagtattattt

SEQ ID NO: 22885 - DNA, 24 bp, Homo sapiens
tgcatacaaaaggtaagtattatt

SEQ ID NO: 22886 - DNA, 24 bp, Homo sapiens
gtgcatacaaaaggtaagtattat

SEQ ID NO: 22887 - DNA, 25 bp, Homo sapiens
aacacaaccgccacagaagcactat

SEQ ID NO: 22888 - DNA, 25 bp, Homo sapiens
aggagactgactgcgtacttacaca

SEQ ID NO: 22889 - DNA, 25 bp, Homo sapiens
tggatacgagaaatcagtgaaagca

SEQ ID NO: 22890 - DNA, 25 bp, Homo sapiens
aggagactgactgcgtacttacaca

SEQ ID NO: 22891 - DNA, 25 bp, Homo sapiens
aacacaaccgccacagaagcactat

SEQ ID NO: 22892 - DNA, 25 bp, Homo sapiens
tgccgtttccagttacaacacaggg

SEQ ID NO: 22893 - DNA, 24 bp, Homo sapiens
aaatagccaaggtaactgttgtgt

SEQ ID NO: 22894 - DNA, 24 bp, Homo sapiens
aaaatagccaaggtaactgttgtg

SEQ ID NO: 22895 - DNA, 24 bp, Homo sapiens
aaaaatagccaaggtaactgttgt

SEQ ID NO: 22896 - DNA, 24 bp, Homo sapiens
ataacatatagatccaaaaaatta

SEQ ID NO: 22897 - DNA, 24 bp, Homo sapiens
tataacatatagatccaaaaaatt

SEQ ID NO: 22898 - DNA, 24 bp, Homo sapiens
ttataacatatagatccaaaaaat

SEQ ID NO: 22899 - DNA, 24 bp, Homo sapiens
ttttttcatagaaaagttagaaga

SEQ ID NO: 22900 - DNA, 24 bp, Homo sapiens
tttttttcatagaaaagttagaag

SEQ ID NO: 22901 - DNA, 24 bp, Homo sapiens
atttttttcatagaaaagttagaa

SEQ ID NO: 22902 - DNA, 24 bp, Homo sapiens
gccatcgccgaagtccttctgaat

SEQ ID NO: 22903 - DNA, 24 bp, Homo sapiens
atgactgcgtgctgttattcctgt

SEQ ID NO: 22904 - DNA, 23 bp, Homo sapiens
caactcaaccgcaagctccgact

SEQ ID NO: 22905 - DNA, 24 bp, Homo sapiens
ggcaggcacaggtgtaatggatag

SEQ ID NO: 22906 - DNA, 24 bp, Homo sapiens
cggcaggcacaggtgtaatggata

SEQ ID NO: 22907 - DNA, 24 bp, Homo sapiens
gcggcaggcacaggtgtaatggat

SEQ ID NO: 22908 - DNA, 23 bp, Homo sapiens
ctcaccacagcctctgcctcctg

SEQ ID NO: 22909 - DNA, 23 bp, Homo sapiens
ggtgctgcgatccttccttcagg

SEQ ID NO: 22910 - DNA, 25 bp, Homo sapiens
aatgctcttaatgaggttggagtgc

SEQ ID NO: 22911 - DNA, 25 bp, Homo sapiens
ggacaccaatttgcagaaacagcga

SEQ ID NO: 22912 - DNA, 25 bp, Homo sapiens
gccaatcaggagcagtatgcagagg

SEQ ID NO: 22913 - DNA, 25 bp, Homo sapiens
aagaagacatctggtctgcaacaga

SEQ ID NO: 22914 - DNA, 25 bp, Homo sapiens
gaagacacatgaggatattgtagcc

SEQ ID NO: 22915 - DNA, 25 bp, Homo sapiens
cctgacctctagttgggatgaatgg

SEQ ID NO: 22916 - DNA, 25 bp, Homo sapiens
gccaatcaggagcagtatgcagagg

SEQ ID NO: 22917 - DNA, 24 bp, Homo sapiens
cctggaaatggagatggtggcagt

SEQ ID NO: 22918 - DNA, 25 bp, Homo sapiens
gccaatcaggagcagtatgcagagg

SEQ ID NO: 22919 - DNA, 25 bp, Homo sapiens
cctgacctctagttgggatgaatgg

SEQ ID NO: 22920 - DNA, 24 bp, Homo sapiens
aaatcccaaaggtaaaatgaaatt

SEQ ID NO: 22921 - DNA, 24 bp, Homo sapiens
aaaatcccaaaggtaaaatgaaat

SEQ ID NO: 22922 - DNA, 24 bp, Homo sapiens
aaaaatcccaaaggtaaaatgaaa

SEQ ID NO: 22923 - DNA, 24 bp, Homo sapiens
cctatgacattgccttggtgaagc

SEQ ID NO: 22924 - DNA, 25 bp, Homo sapiens
acctacactaaacacatccagccca

SEQ ID NO: 22925 - DNA, 23 bp, Homo sapiens
agactgctgggtgactggctggg

SEQ ID NO: 22926 - DNA, 24 bp, Homo sapiens
ttcctctgtagatacctagagatg

SEQ ID NO: 22927 - DNA, 24 bp, Homo sapiens
gttcctctgtagatacctagagat

SEQ ID NO: 22928 - DNA, 24 bp, Homo sapiens
tgttcctctgtagatacctagaga

SEQ ID NO: 22929 - DNA, 23 bp, Homo sapiens
gctgtgttggctgcgattgctct

SEQ ID NO: 22930 - DNA, 25 bp, Homo sapiens
ctcactgtagcctccaactcctaga

SEQ ID NO: 22931 - DNA, 25 bp, Homo sapiens
ctggtctcaaactcctgggctcaag

SEQ ID NO: 22932 - DNA, 23 bp, Homo sapiens
ggactgcgtggtggtggtgaatc

SEQ ID NO: 22933 - DNA, 23 bp, Homo sapiens
tgtgtaagctgttcatcggcggc

SEQ ID NO: 22934 - DNA, 23 bp, Homo sapiens
taaccaacgataacggcggcgac

SEQ ID NO: 22935 - DNA, 24 bp, Homo sapiens
ggcttcgtgacctactccaatgtg

SEQ ID NO: 22936 - DNA, 23 bp, Homo sapiens
ggactgcgtggtggtggtgaatc

SEQ ID NO: 22937 - DNA, 23 bp, Homo sapiens
taaccaacgataacggcggcgac

SEQ ID NO: 22938 - DNA, 24 bp, Homo sapiens
gatcttggctcaccgtaagctccg

SEQ ID NO: 22939 - DNA, 24 bp, Homo sapiens
ttcaagtgaggcttgtgcctagcc

SEQ ID NO: 22940 - DNA, 24 bp, Homo sapiens
attacgaagagagtcaacaaacac

SEQ ID NO: 22941 - DNA, 24 bp, Homo sapiens
aattacgaagagagtcaacaaaca

SEQ ID NO: 22942 - DNA, 24 bp, Homo sapiens
aaattacgaagagagtcaacaaac

SEQ ID NO: 22943 - DNA, 24 bp, Homo sapiens
agatgaaataggtaagaaggaagc

SEQ ID NO: 22944 - DNA, 24 bp, Homo sapiens
aagatgaaataggtaagaaggaag

SEQ ID NO: 22945 - DNA, 24 bp, Homo sapiens
aaagatgaaataggtaagaaggaa

SEQ ID NO: 22946 - DNA, 24 bp, Homo sapiens
atgaatttaaggtaagtaaataaa

SEQ ID NO: 22947 - DNA, 24 bp, Homo sapiens
aatgaatttaaggtaagtaaataa

SEQ ID NO: 22948 - DNA, 24 bp, Homo sapiens
gaatgaatttaaggtaagtaaata

SEQ ID NO: 22949 - DNA, 24 bp, Homo sapiens
ttattattaagattgctctgggaa

SEQ ID NO: 22950 - DNA, 24 bp, Homo sapiens
gttattattaagattgctctggga

SEQ ID NO: 22951 - DNA, 24 bp, Homo sapiens
tgttattattaagattgctctggg

SEQ ID NO: 22952 - DNA, 25 bp, Homo sapiens
caaagtgctgggattagaggcgtga

SEQ ID NO: 22953 - DNA, 23 bp, Homo sapiens
ggacacttctactcaccctgcct

SEQ ID NO: 22954 - DNA, 24 bp, Homo sapiens
aaagttttcaagccaaaaaagctg

SEQ ID NO: 22955 - DNA, 24 bp, Homo sapiens
taaagttttcaagccaaaaaagct

SEQ ID NO: 22956 - DNA, 24 bp, Homo sapiens
ttaaagttttcaagccaaaaaagc

SEQ ID NO: 22957 - DNA, 25 bp, Homo sapiens
acgacaagaaacagcagcaagaaat

SEQ ID NO: 22958 - DNA, 24 bp, Homo sapiens
agacgacaacttctccgcttcctc

SEQ ID NO: 22959 - DNA, 23 bp, Homo sapiens
agctcagagtatcgatgaaatct

SEQ ID NO: 22960 - DNA, 24 bp, Homo sapiens
taaaattgagtctctagccaagag

SEQ ID NO: 22961 - DNA, 24 bp, Homo sapiens
ttaaaattgagtctctagccaaga

SEQ ID NO: 22962 - DNA, 24 bp, Homo sapiens
gttaaaattgagtctctagccaag

SEQ ID NO: 22963 - DNA, 23 bp, Homo sapiens
tggtcccaggcgtgtctaggaag

SEQ ID NO: 22964 - DNA, 25 bp, Homo sapiens
agtgtcgctctgatgtcggctatga

SEQ ID NO: 22965 - DNA, 23 bp, Homo sapiens
acatgacctcgtccagggctctg

SEQ ID NO: 22966 - DNA, 24 bp, Homo sapiens
cgcctcaagaatgaaggtgccaca

SEQ ID NO: 22967 - DNA, 23 bp, Homo sapiens
ccagcaccacacctgctctcacc

SEQ ID NO: 22968 - DNA, 23 bp, Homo sapiens
catatgcggccaggcaactcggc

SEQ ID NO: 22969 - DNA, 24 bp, Homo sapiens
gacaagcttcgggctgccgtggag

SEQ ID NO: 22970 - DNA, 24 bp, Homo sapiens
cgacaagcttcgggctgccgtgga

SEQ ID NO: 22971 - DNA, 24 bp, Homo sapiens
ccgacaagcttcgggctgccgtgg

SEQ ID NO: 22972 - DNA, 25 bp, Homo sapiens
cgccaacaacaagaagattgccaag

SEQ ID NO: 22973 - DNA, 24 bp, Homo sapiens
ggtgatgtgctggtgatggacgag

SEQ ID NO: 22974 - DNA, 23 bp, Homo sapiens
acctgtacttccgagaccgcact

SEQ ID NO: 22975 - DNA, 23 bp, Homo sapiens
ttgctaccgctgctgctgctgaa

SEQ ID NO: 22976 - DNA, 23 bp, Homo sapiens
ggacttggcctttgcggtgcgag

SEQ ID NO: 22977 - DNA, 23 bp, Homo sapiens
gctgcaaaagggctcttcgagct

SEQ ID NO: 22978 - DNA, 24 bp, Homo sapiens
ttgtttttcagaaacaaaaacgga

SEQ ID NO: 22979 - DNA, 24 bp, Homo sapiens
tttgtttttcagaaacaaaaacgg

SEQ ID NO: 22980 - DNA, 24 bp, Homo sapiens
atttgtttttcagaaacaaaaacg

SEQ ID NO: 22981 - DNA, 24 bp, Homo sapiens
aaagcaaaattggaaagagaagca

SEQ ID NO: 22982 - DNA, 24 bp, Homo sapiens
taaagcaaaattggaaagagaagc

SEQ ID NO: 22983 - DNA, 24 bp, Homo sapiens
gtaaagcaaaattggaaagagaag

SEQ ID NO: 22984 - DNA, 24 bp, Homo sapiens
gacagacccagtccgacctcacaa

SEQ ID NO: 22985 - DNA, 24 bp, Homo sapiens
agacagacccagtccgacctcaca

SEQ ID NO: 22986 - DNA, 24 bp, Homo sapiens
cagacagacccagtccgacctcac

SEQ ID NO: 22987 - DNA, 23 bp, Homo sapiens
catccagatgctcacgctactgc

SEQ ID NO: 22988 - DNA, 23 bp, Homo sapiens
tggagcgggtcaacttctggtca

SEQ ID NO: 22989 - DNA, 23 bp, Homo sapiens
tgctgctgctggtggctgtgctg

SEQ ID NO: 22990 - DNA, 24 bp, Homo sapiens
atctccatacagtaagttgtcaaa

SEQ ID NO: 22991 - DNA, 24 bp, Homo sapiens
aatctccatacagtaagttgtcaa

SEQ ID NO: 22992 - DNA, 24 bp, Homo sapiens
aaatctccatacagtaagttgtca

SEQ ID NO: 22993 - DNA, 24 bp, Homo sapiens
taaaaaaaaaaagtcaataaactg

SEQ ID NO: 22994 - DNA, 24 bp, Homo sapiens
ttaaaaaaaaaaagtcaataaact

SEQ ID NO: 22995 - DNA, 24 bp, Homo sapiens
cttaaaaaaaaaaagtcaataaac

SEQ ID NO: 22996 - DNA, 24 bp, Homo sapiens
taaatgatgaggtaattttgaaga

SEQ ID NO: 22997 - DNA, 24 bp, Homo sapiens
gtaaatgatgaggtaattttgaag

SEQ ID NO: 22998 - DNA, 24 bp, Homo sapiens
agtaaatgatgaggtaattttgaa

SEQ ID NO: 22999 - DNA, 24 bp, Homo sapiens
aaagatgactgaatactgggttcc

SEQ ID NO: 23000 - DNA, 24 bp, Homo sapiens
agaagacaactttacaaggatcta

SEQ ID NO: 23001 - DNA, 24 bp, Homo sapiens
gcctgcgaggagtcacattaactt

SEQ ID NO: 23002 - DNA, 24 bp, Homo sapiens
gagacagtgtggaactcttcattt

SEQ ID NO: 23003 - DNA, 24 bp, Homo sapiens
ggagacagtgtggaactcttcatt

SEQ ID NO: 23004 - DNA, 24 bp, Homo sapiens
gggagacagtgtggaactcttcat

SEQ ID NO: 23005 - DNA, 23 bp, Homo sapiens
tgaggcaggcggatcacttgatg

SEQ ID NO: 23006 - DNA, 23 bp, Homo sapiens
aagaatatgtaatggaccaggcg

SEQ ID NO: 23007 - DNA, 24 bp, Homo sapiens
aattgccctcctttggaagtacgg

SEQ ID NO: 23008 - DNA, 25 bp, Homo sapiens
gcaatggctactagaaggacgaaca

SEQ ID NO: 23009 - DNA, 23 bp, Homo sapiens
gcagtgcctcacgcctgtcatcc

SEQ ID NO: 23010 - DNA, 23 bp, Homo sapiens
tgaggcaggcggatcacttgatg

SEQ ID NO: 23011 - DNA, 23 bp, Homo sapiens
tgaggcaggcggatcacttgatg

SEQ ID NO: 23012 - DNA, 25 bp, Homo sapiens
ataagaatatgtaatggaccaggcg

SEQ ID NO: 23013 - DNA, 25 bp, Homo sapiens
gcaatggctactagaaggacgaaca

SEQ ID NO: 23014 - DNA, 24 bp, Homo sapiens
ttaccaagcagggaggttcccctg

SEQ ID NO: 23015 - DNA, 24 bp, Homo sapiens
attaccaagcagggaggttcccct

SEQ ID NO: 23016 - DNA, 24 bp, Homo sapiens
tattaccaagcagggaggttcccc

SEQ ID NO: 23017 - DNA, 24 bp, Homo sapiens
tttttcaaacaggctggtgaatta

SEQ ID NO: 23018 - DNA, 24 bp, Homo sapiens
atttttcaaacaggctggtgaatt

SEQ ID NO: 23019 - DNA, 24 bp, Homo sapiens
tatttttcaaacaggctggtgaat

SEQ ID NO: 23020 - DNA, 25 bp, Homo sapiens
gctgtttcctctgcctctcctctac

SEQ ID NO: 23021 - DNA, 24 bp, Homo sapiens
ccttggaattggacagatggcagc

SEQ ID NO: 23022 - DNA, 23 bp, Homo sapiens
gctgctgaccacctacggtttcc

SEQ ID NO: 23023 - DNA, 24 bp, Homo sapiens
aaaagaaacaggtgaatatttatc

SEQ ID NO: 23024 - DNA, 24 bp, Homo sapiens
caaaagaaacaggtgaatatttat

SEQ ID NO: 23025 - DNA, 24 bp, Homo sapiens
gcaaaagaaacaggtgaatattta

SEQ ID NO: 23026 - DNA, 24 bp, Homo sapiens
aaaagaaacaggtatttttaattt

SEQ ID NO: 23027 - DNA, 24 bp, Homo sapiens
caaaagaaacaggtatttttaatt

SEQ ID NO: 23028 - DNA, 24 bp, Homo sapiens
gcaaaagaaacaggtatttttaat

SEQ ID NO: 23029 - DNA, 24 bp, Homo sapiens
gacgagccagccgagagcccatcg

SEQ ID NO: 23030 - DNA, 24 bp, Homo sapiens
ggacgagccagccgagagcccatc

SEQ ID NO: 23031 - DNA, 24 bp, Homo sapiens
gggacgagccagccgagagcccat

SEQ ID NO: 23032 - DNA, 24 bp, Homo sapiens
tcctctttatctccgccttcctgg

SEQ ID NO: 23033 - DNA, 23 bp, Homo sapiens
cgacggcggcgtgtggatggagg

SEQ ID NO: 23034 - DNA, 23 bp, Homo sapiens
ccggctccctgctctctcgggcc

SEQ ID NO: 23035 - DNA, 25 bp, Homo sapiens
caatagcagcctggtgtatggagca

SEQ ID NO: 23036 - DNA, 23 bp, Homo sapiens
ccccgtgatggaattcattgcct

SEQ ID NO: 23037 - DNA, 23 bp, Homo sapiens
cttataagccattatcttcagtt

SEQ ID NO: 23038 - DNA, 24 bp, Homo sapiens
atttgtgccagtctaatgcactac

SEQ ID NO: 23039 - DNA, 24 bp, Homo sapiens
tatttgtgccagtctaatgcacta

SEQ ID NO: 23040 - DNA, 24 bp, Homo sapiens
ttatttgtgccagtctaatgcact

SEQ ID NO: 23041 - DNA, 23 bp, Homo sapiens
gagaccagcctgagcaacagagc

SEQ ID NO: 23042 - DNA, 24 bp, Homo sapiens
gcagtagcctcctgtcctgtctct

SEQ ID NO: 23043 - DNA, 24 bp, Homo sapiens
cctccttcagtctgttggtcacac

SEQ ID NO: 23044 - DNA, 24 bp, Homo sapiens
atttccagaatgtaagtatatttc

SEQ ID NO: 23045 - DNA, 24 bp, Homo sapiens
gatttccagaatgtaagtatattt

SEQ ID NO: 23046 - DNA, 24 bp, Homo sapiens
tgatttccagaatgtaagtatatt

SEQ ID NO: 23047 - DNA, 25 bp, Homo sapiens
agagatggcagaacgcaatgaggat

SEQ ID NO: 23048 - DNA, 25 bp, Homo sapiens
aggtccttaaagaatctgaggtgct

SEQ ID NO: 23049 - DNA, 23 bp, Homo sapiens
acaagtcagcagcaggagatggc

SEQ ID NO: 23050 - DNA, 23 bp, Homo sapiens
ccttgaacacacatgctgccgag

SEQ ID NO: 23051 - DNA, 23 bp, Homo sapiens
aagcaggtcaccagccaggagcc

SEQ ID NO: 23052 - DNA, 23 bp, Homo sapiens
ccagcctgtccttgtgtcgtctt

SEQ ID NO: 23053 - DNA, 24 bp, Homo sapiens
ggaaatctcaacctaatgctgccg

SEQ ID NO: 23054 - DNA, 25 bp, Homo sapiens
agcctgggtgacagagtgagacttt

SEQ ID NO: 23055 - DNA, 25 bp, Homo sapiens
aagagaatgtaaaaatcgaaagaga

SEQ ID NO: 23056 - DNA, 23 bp, Homo sapiens
tgggattacaggcgtgagccacc

SEQ ID NO: 23057 - DNA, 23 bp, Homo sapiens
tttaagtaacatatttcagcatt

SEQ ID NO: 23058 - DNA, 24 bp, Homo sapiens
ccgatctgctcaacttcaagaagg

SEQ ID NO: 23059 - DNA, 23 bp, Homo sapiens
cgttcctgcctcctgctcccgcc

SEQ ID NO: 23060 - DNA, 23 bp, Homo sapiens
ggcggcggcggcggcggcggcgg

SEQ ID NO: 23061 - DNA, 23 bp, Homo sapiens
cgttcctgcctcctgctcccgcc

SEQ ID NO: 23062 - DNA, 23 bp, Homo sapiens
ttttatgggcggatggaaggggc

SEQ ID NO: 23063 - DNA, 23 bp, Homo sapiens
ggcggcggcggcggcggcggcgg

SEQ ID NO: 23064 - DNA, 24 bp, Homo sapiens
cacaacaacaggtttatgatttgc

SEQ ID NO: 23065 - DNA, 24 bp, Homo sapiens
tcacaacaacaggtttatgatttg

SEQ ID NO: 23066 - DNA, 24 bp, Homo sapiens
ctcacaacaacaggtttatgattt

SEQ ID NO: 23067 - DNA, 23 bp, Homo sapiens
aagatggctgctgcggaggcgtt

SEQ ID NO: 23068 - DNA, 23 bp, Homo sapiens
ggaaatctggaaccgggatggcg

SEQ ID NO: 23069 - DNA, 23 bp, Homo sapiens
ccagagtcaaaaggcgtcggccc

SEQ ID NO: 23070 - DNA, 24 bp, Homo sapiens
gcttccgccatattgattctgctt

SEQ ID NO: 23071 - DNA, 24 bp, Homo sapiens
taatgaggagcaggttggactggc

SEQ ID NO: 23072 - DNA, 24 bp, Homo sapiens
gcagatggcagtgtgaagagagaa

SEQ ID NO: 23073 - DNA, 24 bp, Homo sapiens
tgctgcagcacgggacgacttagc

SEQ ID NO: 23074 - DNA, 24 bp, Homo sapiens
gtgctgcagcacgggacgacttag

SEQ ID NO: 23075 - DNA, 24 bp, Homo sapiens
ggtgctgcagcacgggacgactta

SEQ ID NO: 23076 - DNA, 23 bp, Homo sapiens
cagaggcagaggcagaggcagag

SEQ ID NO: 23077 - DNA, 23 bp, Homo sapiens
ccgatgtcttccaggctcaccag

SEQ ID NO: 23078 - DNA, 24 bp, Homo sapiens
cgctatgtgctcaccaacctcaac

SEQ ID NO: 23079 - DNA, 23 bp, Homo sapiens
ctccaggacggaccacagccacc

SEQ ID NO: 23080 - DNA, 23 bp, Homo sapiens
cggtgactgtgcgtggctgctgg

SEQ ID NO: 23081 - DNA, 23 bp, Homo sapiens
ggcatgttggcacctggatggag

SEQ ID NO: 23082 - DNA, 25 bp, Homo sapiens
catcaccttcacctacttccagcct

SEQ ID NO: 23083 - DNA, 23 bp, Homo sapiens
gaggagtatggcaacctcacccg

SEQ ID NO: 23084 - DNA, 23 bp, Homo sapiens
ctgggtgtgggccgctgtgcgtg

SEQ ID NO: 23085 - DNA, 24 bp, Homo sapiens
acatccagaaacatgacaacgtga

SEQ ID NO: 23086 - DNA, 24 bp, Homo sapiens
aacggctcctgctgtctgtccttc

SEQ ID NO: 23087 - DNA, 24 bp, Homo sapiens
agagacaggctttccaggagaccc

SEQ ID NO: 23088 - DNA, 24 bp, Homo sapiens
ttctcttctaggtttctccatttc

SEQ ID NO: 23089 - DNA, 24 bp, Homo sapiens
tttctcttctaggtttctccattt

SEQ ID NO: 23090 - DNA, 24 bp, Homo sapiens
ctttctcttctaggtttctccatt

SEQ ID NO: 23091 - DNA, 24 bp, Homo sapiens
aatgttcgatggtaagttatatca

SEQ ID NO: 23092 - DNA, 24 bp, Homo sapiens
caatgttcgatggtaagttatatc

SEQ ID NO: 23093 - DNA, 24 bp, Homo sapiens
ccaatgttcgatggtaagttatat

SEQ ID NO: 23094 - DNA, 24 bp, Homo sapiens
gctgtttttaggggaaaccaccct

SEQ ID NO: 23095 - DNA, 24 bp, Homo sapiens
tgctgtttttaggggaaaccaccc

SEQ ID NO: 23096 - DNA, 24 bp, Homo sapiens
ttgctgtttttaggggaaaccacc

SEQ ID NO: 23097 - DNA, 24 bp, Homo sapiens
agaggtggaggctgtgcttagtca

SEQ ID NO: 23098 - DNA, 25 bp, Homo sapiens
ggaccttgctacctacatcacagaa

SEQ ID NO: 23099 - DNA, 23 bp, Homo sapiens
ttggagcaagcacggatggaggt

SEQ ID NO: 23100 - DNA, 24 bp, Homo sapiens
aaaagattaaaatgatcaatgcta

SEQ ID NO: 23101 - DNA, 24 bp, Homo sapiens
gaaaagattaaaatgatcaatgct

SEQ ID NO: 23102 - DNA, 24 bp, Homo sapiens
ggaaaagattaaaatgatcaatgc

SEQ ID NO: 23103 - DNA, 25 bp, Homo sapiens
gtaggactgaacatgcgagccacaa

SEQ ID NO: 23104 - DNA, 24 bp, Homo sapiens
gcttgcctgctgaatatgccacac

SEQ ID NO: 23105 - DNA, 23 bp, Homo sapiens
cagaccaaggagcccagcagcag

SEQ ID NO: 23106 - DNA, 24 bp, Homo sapiens
acttacggtttgaggaaggaacct

SEQ ID NO: 23107 - DNA, 24 bp, Homo sapiens
aacttacggtttgaggaaggaacc

SEQ ID NO: 23108 - DNA, 24 bp, Homo sapiens
aaacttacggtttgaggaaggaac

SEQ ID NO: 23109 - DNA, 24 bp, Homo sapiens
gcccgcgaaagtttgtcggctcct

SEQ ID NO: 23110 - DNA, 24 bp, Homo sapiens
ccttagcggggccaccgagcgatg

SEQ ID NO: 23111 - DNA, 24 bp, Homo sapiens
ccgccccccgccgcccgccgcccc

SEQ ID NO: 23112 - DNA, 24 bp, Homo sapiens
atcaaaaggagaagaaatgcttat

SEQ ID NO: 23113 - DNA, 24 bp, Homo sapiens
catcaaaaggagaagaaatgctta

SEQ ID NO: 23114 - DNA, 24 bp, Homo sapiens
ccatcaaaaggagaagaaatgctt

SEQ ID NO: 23115 - DNA, 23 bp, Homo sapiens
cagggctacgggttcaaggagga

SEQ ID NO: 23116 - DNA, 23 bp, Homo sapiens
gaggctgctggtgctggatggag

SEQ ID NO: 23117 - DNA, 25 bp, Homo sapiens
atgccaactacattgacggatacca

SEQ ID NO: 23118 - DNA, 23 bp, Homo sapiens
gaggctgctggtgctggatggag

SEQ ID NO: 23119 - DNA, 23 bp, Homo sapiens
cagggctacgggttcaaggagga

SEQ ID NO: 23120 - DNA, 24 bp, Homo sapiens
atccagactcatccctaccgcacc

SEQ ID NO: 23121 - DNA, 23 bp, Homo sapiens
aggtgccgtctgcctcccaggtg

SEQ ID NO: 23122 - DNA, 25 bp, Homo sapiens
gcctgaaggttaccgagtgcatgag

SEQ ID NO: 23123 - DNA, 24 bp, Homo sapiens
gcttaacgccgctgaaggtatccg

SEQ ID NO: 23124 - DNA, 23 bp, Homo sapiens
ggctcctcccacctaagtctctt

SEQ ID NO: 23125 - DNA, 25 bp, Homo sapiens
gaagatcatacctcactacatccgt

SEQ ID NO: 23126 - DNA, 23 bp, Homo sapiens
gagggtctcactgtcaaccaggc

SEQ ID NO: 23127 - DNA, 25 bp, Homo sapiens
caacatttgcttcaagttcctgggc

SEQ ID NO: 23128 - DNA, 23 bp, Homo sapiens
agcgtgcaggatgctgttggaac

SEQ ID NO: 23129 - DNA, 23 bp, Homo sapiens
gaggctgctgtgccctggccatc

SEQ ID NO: 23130 - DNA, 23 bp, Homo sapiens
ctgactcgcagccgcagccatag

SEQ ID NO: 23131 - DNA, 23 bp, Homo sapiens
cgccatcacccgcaagagagaag

SEQ ID NO: 23132 - DNA, 23 bp, Homo sapiens
caccacagcagtagccgcagccg

SEQ ID NO: 23133 - DNA, 25 bp, Homo sapiens
gctgtttcctgaggctaaagaccat

SEQ ID NO: 23134 - DNA, 24 bp, Homo sapiens
gtcatctctaccagcagcagcagc

SEQ ID NO: 23135 - DNA, 25 bp, Homo sapiens
ggtctctgctgatgaaatgggctcc

SEQ ID NO: 23136 - DNA, 24 bp, Homo sapiens
gaccctgagcagaggacccagttt

SEQ ID NO: 23137 - DNA, 24 bp, Homo sapiens
ggctgacacctggattgcagactc

SEQ ID NO: 23138 - DNA, 24 bp, Homo sapiens
aactgggagataaaactctgtggt

SEQ ID NO: 23139 - DNA, 24 bp, Homo sapiens
tgaaagatacatttataatcaaga

SEQ ID NO: 23140 - DNA, 24 bp, Homo sapiens
ctgaaagatacatttataatcaag

SEQ ID NO: 23141 - DNA, 24 bp, Homo sapiens
tctgaaagatacatttataatcaa

SEQ ID NO: 23142 - DNA, 24 bp, Homo sapiens
caaatgccttgtcgaagtccagcg

SEQ ID NO: 23143 - DNA, 24 bp, Homo sapiens
aatgaaggaatggtgactcgctgc

SEQ ID NO: 23144 - DNA, 24 bp, Homo sapiens
ggctggcggctgtcaattccatgc

SEQ ID NO: 23145 - DNA, 23 bp, Homo sapiens
ccaccttgatgctcatggcttcg

SEQ ID NO: 23146 - DNA, 23 bp, Homo sapiens
cagccttgccccagcccactccc

SEQ ID NO: 23147 - DNA, 23 bp, Homo sapiens
cctccgccgtggatgggatgggc

SEQ ID NO: 23148 - DNA, 25 bp, Homo sapiens
tcctcctactcggacttcatctcct

SEQ ID NO: 23149 - DNA, 24 bp, Homo sapiens
gtgaggaagctggctggagacatg

SEQ ID NO: 23150 - DNA, 23 bp, Homo sapiens
ggcagaaggacaggtggagggaa

SEQ ID NO: 23151 - DNA, 24 bp, Homo sapiens
ccaggcaccaggcaccaacggaga

SEQ ID NO: 23152 - DNA, 24 bp, Homo sapiens
accaggcaccaggcaccaacggag

SEQ ID NO: 23153 - DNA, 24 bp, Homo sapiens
aaccaggcaccaggcaccaacgga

SEQ ID NO: 23154 - DNA, 24 bp, Homo sapiens
tattttcccagaagtgattatttt

SEQ ID NO: 23155 - DNA, 24 bp, Homo sapiens
ttattttcccagaagtgattattt

SEQ ID NO: 23156 - DNA, 24 bp, Homo sapiens
cttattttcccagaagtgattatt

SEQ ID NO: 23157 - DNA, 24 bp, Homo sapiens
aatctcagaaggtatatctttaaa

SEQ ID NO: 23158 - DNA, 24 bp, Homo sapiens
aaatctcagaaggtatatctttaa

SEQ ID NO: 23159 - DNA, 24 bp, Homo sapiens
aaaatctcagaaggtatatcttta

SEQ ID NO: 23160 - DNA, 24 bp, Homo sapiens
ttgcttttcagagaacacgtaaca

SEQ ID NO: 23161 - DNA, 24 bp, Homo sapiens
tttgcttttcagagaacacgtaac

SEQ ID NO: 23162 - DNA, 24 bp, Homo sapiens
gtttgcttttcagagaacacgtaa

SEQ ID NO: 23163 - DNA, 24 bp, Homo sapiens
ttaattaacaggattatggcttca

SEQ ID NO: 23164 - DNA, 24 bp, Homo sapiens
tttaattaacaggattatggcttc

SEQ ID NO: 23165 - DNA, 24 bp, Homo sapiens
ttttaattaacaggattatggctt

SEQ ID NO: 23166 - DNA, 24 bp, Homo sapiens
catagagtaaggtaaaagcaagtt

SEQ ID NO: 23167 - DNA, 24 bp, Homo sapiens
ccatagagtaaggtaaaagcaagt

SEQ ID NO: 23168 - DNA, 24 bp, Homo sapiens
tccatagagtaaggtaaaagcaag

SEQ ID NO: 23169 - DNA, 24 bp, Homo sapiens
ttgaggcgaatccatagagtaagc

SEQ ID NO: 23170 - DNA, 25 bp, Homo sapiens
agcccaagcaaagccatcatatccc

SEQ ID NO: 23171 - DNA, 25 bp, Homo sapiens
cggttcctgccttaactgatgacat

SEQ ID NO: 23172 - DNA, 24 bp, Homo sapiens
catagagtaagatggagttttgct

SEQ ID NO: 23173 - DNA, 24 bp, Homo sapiens
ccatagagtaagatggagttttgc

SEQ ID NO: 23174 - DNA, 24 bp, Homo sapiens
tccatagagtaagatggagttttg

SEQ ID NO: 23175 - DNA, 24 bp, Homo sapiens
aaaggtgggagtttttctcacacc

SEQ ID NO: 23176 - DNA, 24 bp, Homo sapiens
taaaggtgggagtttttctcacac

SEQ ID NO: 23177 - DNA, 24 bp, Homo sapiens
ctaaaggtgggagtttttctcaca

SEQ ID NO: 23178 - DNA, 23 bp, Homo sapiens
gttcgcccgtgaaggggcaggac

SEQ ID NO: 23179 - DNA, 23 bp, Homo sapiens
ggctcccacaccactgcctcgtg

SEQ ID NO: 23180 - DNA, 24 bp, Homo sapiens
cagcatctcaggttccagttacag

SEQ ID NO: 23181 - DNA, 24 bp, Homo sapiens
gcagcatctcaggttccagttaca

SEQ ID NO: 23182 - DNA, 24 bp, Homo sapiens
ggcagcatctcaggttccagttac

SEQ ID NO: 23183 - DNA, 25 bp, Homo sapiens
aagtgatcctcctacctcagcctcc

SEQ ID NO: 23184 - DNA, 24 bp, Homo sapiens
tggctcactacaccctggatctcc

SEQ ID NO: 23185 - DNA, 23 bp, Homo sapiens
acccaggctggagtgcagaggtg

SEQ ID NO: 23186 - DNA, 23 bp, Homo sapiens
cctaccgagttggcgtccgagat

SEQ ID NO: 23187 - DNA, 25 bp, Homo sapiens
actcgcctgtcttaccaagttgtca

SEQ ID NO: 23188 - DNA, 23 bp, Homo sapiens
tggctgggagaggtctgatggtg

SEQ ID NO: 23189 - DNA, 24 bp, Homo sapiens
tctctctacagcagacataaacgt

SEQ ID NO: 23190 - DNA, 24 bp, Homo sapiens
ttctctctacagcagacataaacg

SEQ ID NO: 23191 - DNA, 24 bp, Homo sapiens
cttctctctacagcagacataaac

SEQ ID NO: 23192 - DNA, 24 bp, Homo sapiens
cggaaccgcactgacaataccctc

SEQ ID NO: 23193 - DNA, 24 bp, Homo sapiens
tcggaaccgcactgacaataccct

SEQ ID NO: 23194 - DNA, 24 bp, Homo sapiens
ctcggaaccgcactgacaataccc

SEQ ID NO: 23195 - DNA, 25 bp, Homo sapiens
tgaatctgccagcaccttgatcttg

SEQ ID NO: 23196 - DNA, 24 bp, Homo sapiens
atcgtctgtaaagaatgagccctt

SEQ ID NO: 23197 - DNA, 25 bp, Homo sapiens
aatggcacaatctcaactcaccgca

SEQ ID NO: 23198 - DNA, 25 bp, Homo sapiens
agggcagaaatgaggtgggagaagt

SEQ ID NO: 23199 - DNA, 23 bp, Homo sapiens
gagactcgctttgtcacccaggc

SEQ ID NO: 23200 - DNA, 23 bp, Homo sapiens
ctcccacctccgcttacagctcg

SEQ ID NO: 23201 - DNA, 23 bp, Homo sapiens
ccgtcctgccccgcgcccccagg

SEQ ID NO: 23202 - DNA, 24 bp, Homo sapiens
aatgaggaggcacagaccagtgtc

SEQ ID NO: 23203 - DNA, 23 bp, Homo sapiens
ccagcatcttctccacttcagcg

SEQ ID NO: 23204 - DNA, 24 bp, Homo sapiens
acaagtgtctgctacagtcgccaa

SEQ ID NO: 23205 - DNA, 24 bp, Homo sapiens
ttaatttgtagaaacatcaatgga

SEQ ID NO: 23206 - DNA, 24 bp, Homo sapiens
tttaatttgtagaaacatcaatgg

SEQ ID NO: 23207 - DNA, 24 bp, Homo sapiens
ttttaatttgtagaaacatcaatg

SEQ ID NO: 23208 - DNA, 24 bp, Homo sapiens
aaactcagttggtgtggaactcta

SEQ ID NO: 23209 - DNA, 24 bp, Homo sapiens
aaaactcagttggtgtggaactct

SEQ ID NO: 23210 - DNA, 24 bp, Homo sapiens
gaaaactcagttggtgtggaactc

SEQ ID NO: 23211 - DNA, 24 bp, Homo sapiens
agacaataagggtaatactttctt

SEQ ID NO: 23212 - DNA, 24 bp, Homo sapiens
tagacaataagggtaatactttct

SEQ ID NO: 23213 - DNA, 24 bp, Homo sapiens
ttagacaataagggtaatactttc

SEQ ID NO: 23214 - DNA, 24 bp, Homo sapiens
ctcgggcacagttttggcattcag

SEQ ID NO: 23215 - DNA, 24 bp, Homo sapiens
gctcgggcacagttttggcattca

SEQ ID NO: 23216 - DNA, 24 bp, Homo sapiens
agctcgggcacagttttggcattc

SEQ ID NO: 23217 - DNA, 23 bp, Homo sapiens
gatggtggctggtctggctggag

SEQ ID NO: 23218 - DNA, 23 bp, Homo sapiens
cacgcagcctacgcccaaataca

SEQ ID NO: 23219 - DNA, 24 bp, Homo sapiens
gccactttgacgctatgctctaca

SEQ ID NO: 23220 - DNA, 24 bp, Homo sapiens
ctcaggcaactggagtaagtgctc

SEQ ID NO: 23221 - DNA, 23 bp, Homo sapiens
gctggtacacatcttcctggagg

SEQ ID NO: 23222 - DNA, 23 bp, Homo sapiens
gtggtgagcagcagcgtctagtg

SEQ ID NO: 23223 - DNA, 23 bp, Homo sapiens
gaggttcctcagtgcgggacgtg

SEQ ID NO: 23224 - DNA, 23 bp, Homo sapiens
ccactgcggcccttccattgtca

SEQ ID NO: 23225 - DNA, 23 bp, Homo sapiens
cctgccaagccgcctgcgcaccg

SEQ ID NO: 23226 - DNA, 24 bp, Homo sapiens
aactcagcaagcgtcagcttttct

SEQ ID NO: 23227 - DNA, 24 bp, Homo sapiens
aaactcagcaagcgtcagcttttc

SEQ ID NO: 23228 - DNA, 24 bp, Homo sapiens
aaaactcagcaagcgtcagctttt

SEQ ID NO: 23229 - DNA, 24 bp, Homo sapiens
tttattcacagatgaatagaccta

SEQ ID NO: 23230 - DNA, 24 bp, Homo sapiens
ttttattcacagatgaatagacct

SEQ ID NO: 23231 - DNA, 24 bp, Homo sapiens
attttattcacagatgaatagacc

SEQ ID NO: 23232 - DNA, 24 bp, Homo sapiens
tttcaaaatgggtaagtgattttt

SEQ ID NO: 23233 - DNA, 24 bp, Homo sapiens
ttttcaaaatgggtaagtgatttt

SEQ ID NO: 23234 - DNA, 24 bp, Homo sapiens
cttttcaaaatgggtaagtgattt

SEQ ID NO: 23235 - DNA, 23 bp, Homo sapiens
gattacacggcactgtccagcgg

SEQ ID NO: 23236 - DNA, 25 bp, Homo sapiens
acttcttctacatcaaggtcagcca

SEQ ID NO: 23237 - DNA, 24 bp, Homo sapiens
gcaagtcctcccacctcaagaagc

SEQ ID NO: 23238 - DNA, 24 bp, Homo sapiens
gttgttctaaggtacattttatat

SEQ ID NO: 23239 - DNA, 24 bp, Homo sapiens
tgttgttctaaggtacattttata

SEQ ID NO: 23240 - DNA, 24 bp, Homo sapiens
atgttgttctaaggtacattttat

SEQ ID NO: 23241 - DNA, 23 bp, Homo sapiens
gcgggcaacctcggagcttatac

SEQ ID NO: 23242 - DNA, 23 bp, Homo sapiens
cgaggatcgacatggacgctctc

SEQ ID NO: 23243 - DNA, 23 bp, Homo sapiens
cagtgacgggtctggagtgcgtg

SEQ ID NO: 23244 - DNA, 24 bp, Homo sapiens
gctgttggcgggctggagtgcagt

SEQ ID NO: 23245 - DNA, 24 bp, Homo sapiens
ggctgttggcgggctggagtgcag

SEQ ID NO: 23246 - DNA, 24 bp, Homo sapiens
cggctgttggcgggctggagtgca

SEQ ID NO: 23247 - DNA, 23 bp, Homo sapiens
cagctcatggcagtgttcggatc

SEQ ID NO: 23248 - DNA, 25 bp, Homo sapiens
cggtgtacgtgtctgagattgctcc

SEQ ID NO: 23249 - DNA, 23 bp, Homo sapiens
ctctggatgctgctgctcggaag

SEQ ID NO: 23250 - DNA, 24 bp, Homo sapiens
agcagccccaggaagcaactgtca

SEQ ID NO: 23251 - DNA, 24 bp, Homo sapiens
cagcagccccaggaagcaactgtc

SEQ ID NO: 23252 - DNA, 24 bp, Homo sapiens
gcagcagccccaggaagcaactgt

SEQ ID NO: 23253 - DNA, 24 bp, Homo sapiens
cgactatgacacactctccctgcg

SEQ ID NO: 23254 - DNA, 23 bp, Homo sapiens
ctacagcctggtgtctgagcagc

SEQ ID NO: 23255 - DNA, 23 bp, Homo sapiens
cagcgattccagagcagccaccg

SEQ ID NO: 23256 - DNA, 24 bp, Homo sapiens
atcatcttcctgcccttcacctgc

SEQ ID NO: 23257 - DNA, 25 bp, Homo sapiens
ccaccaatcaggacttcatccagcg

SEQ ID NO: 23258 - DNA, 25 bp, Homo sapiens
gaggaggaggaagaagaggaggacg

SEQ ID NO: 23259 - DNA, 24 bp, Homo sapiens
gcttaacttatttatttattgcat

SEQ ID NO: 23260 - DNA, 23 bp, Homo sapiens
tttaaagagttggtcttttctgt

SEQ ID NO: 23261 - DNA, 23 bp, Homo sapiens
aaagaaaaaagtttaaaagcatc

SEQ ID NO: 23262 - DNA, 23 bp, Homo sapiens
caccaccacctcaacagcagcag

SEQ ID NO: 23263 - DNA, 23 bp, Homo sapiens
agcagcaacagcagcagcagcaa

SEQ ID NO: 23264 - DNA, 24 bp, Homo sapiens
caacatcttcatctaccacctgcc

SEQ ID NO: 23265 - DNA, 24 bp, Homo sapiens
aaagtaggaaggtagagttgttgg

SEQ ID NO: 23266 - DNA, 24 bp, Homo sapiens
aaaagtaggaaggtagagttgttg

SEQ ID NO: 23267 - DNA, 24 bp, Homo sapiens
caaaagtaggaaggtagagttgtt

SEQ ID NO: 23268 - DNA, 25 bp, Homo sapiens
gtaggaaggtagagttgttggcaga

SEQ ID NO: 23269 - DNA, 25 bp, Homo sapiens
ttcattgaactcaacagagccaaca

SEQ ID NO: 23270 - DNA, 24 bp, Homo sapiens
aagaggaggttgaagtggcatggc

SEQ ID NO: 23271 - DNA, 24 bp, Homo sapiens
tcagctgtcaggtactctgatggc

SEQ ID NO: 23272 - DNA, 24 bp, Homo sapiens
ctcagctgtcaggtactctgatgg

SEQ ID NO: 23273 - DNA, 24 bp, Homo sapiens
tctcagctgtcaggtactctgatg

SEQ ID NO: 23274 - DNA, 23 bp, Homo sapiens
gtgaccacgcccagtccgcactc

SEQ ID NO: 23275 - DNA, 23 bp, Homo sapiens
gcgtgtcagccagaaggagggga

SEQ ID NO: 23276 - DNA, 23 bp, Homo sapiens
atggctgtggacatgcggagggc

SEQ ID NO: 23277 - DNA, 23 bp, Homo sapiens
tacctggtgctgctgtcccacgt

SEQ ID NO: 23278 - DNA, 23 bp, Homo sapiens
atggctgtggacatgcggagggc

SEQ ID NO: 23279 - DNA, 23 bp, Homo sapiens
tgagccgcttgacaactgacgtg

SEQ ID NO: 23280 - DNA, 23 bp, Homo sapiens
tacctggtgctgctgtcccacgt

SEQ ID NO: 23281 - DNA, 24 bp, Homo sapiens
agttttactgtactttcttgtctg

SEQ ID NO: 23282 - DNA, 24 bp, Homo sapiens
cagttttactgtactttcttgtct

SEQ ID NO: 23283 - DNA, 24 bp, Homo sapiens
tcagttttactgtactttcttgtc

SEQ ID NO: 23284 - DNA, 24 bp, Homo sapiens
ttgttctctagttcagccagatcc

SEQ ID NO: 23285 - DNA, 24 bp, Homo sapiens
tttgttctctagttcagccagatc

SEQ ID NO: 23286 - DNA, 24 bp, Homo sapiens
ttttgttctctagttcagccagat

SEQ ID NO: 23287 - DNA, 24 bp, Homo sapiens
ttaaaaaccaggatttgaagaaga

SEQ ID NO: 23288 - DNA, 24 bp, Homo sapiens
tttaaaaaccaggatttgaagaag

SEQ ID NO: 23289 - DNA, 24 bp, Homo sapiens
ttttaaaaaccaggatttgaagaa

SEQ ID NO: 23290 - DNA, 24 bp, Homo sapiens
ggctatggctgtgactctggacaa

SEQ ID NO: 23291 - DNA, 24 bp, Homo sapiens
ggtcattgggagagtgcgggattc

SEQ ID NO: 23292 - DNA, 23 bp, Homo sapiens
aaacctaacgctgttgggacccg

SEQ ID NO: 23293 - DNA, 23 bp, Homo sapiens
cagtggaggcagaggcaagaacc

SEQ ID NO: 23294 - DNA, 25 bp, Homo sapiens
tggatgtcactgaagaagaaggcaa

SEQ ID NO: 23295 - DNA, 25 bp, Homo sapiens
tgtgaggtagtgtcctgaacatcca

SEQ ID NO: 23296 - DNA, 25 bp, Homo sapiens
tcttccagatgaaccagagcagcct

SEQ ID NO: 23297 - DNA, 24 bp, Homo sapiens
gataccgaggtgacaacgacagcg

SEQ ID NO: 23298 - DNA, 23 bp, Homo sapiens
tgatggcggtgctggtgctgctc

SEQ ID NO: 23299 - DNA, 23 bp, Homo sapiens
actggtgcctggtgtgtggtttg

SEQ ID NO: 23300 - DNA, 23 bp, Homo sapiens
ggctgggatggctctgagggtct

SEQ ID NO: 23301 - DNA, 25 bp, Homo sapiens
gcacctgggttgagactctttggac

SEQ ID NO: 23302 - DNA, 24 bp, Homo sapiens
ctttttatctggtaagaaatattt

SEQ ID NO: 23303 - DNA, 24 bp, Homo sapiens
tctttttatctggtaagaaatatt

SEQ ID NO: 23304 - DNA, 24 bp, Homo sapiens
ttctttttatctggtaagaaatat

SEQ ID NO: 23305 - DNA, 23 bp, Homo sapiens
ttaccagatgctcttggctgtgc

SEQ ID NO: 23306 - DNA, 24 bp, Homo sapiens
acaccgtgacttaaagccagagaa

SEQ ID NO: 23307 - DNA, 25 bp, Homo sapiens
actgtcatctcaagaagaggactgt

SEQ ID NO: 23308 - DNA, 23 bp, Homo sapiens
cctccctctgccttgtgttacgc

SEQ ID NO: 23309 - DNA, 23 bp, Homo sapiens
aatccctcagccagcccgacgaa

SEQ ID NO: 23310 - DNA, 25 bp, Homo sapiens
cttgggtgtaaatgagaagggtggg

SEQ ID NO: 23311 - DNA, 24 bp, Homo sapiens
agcctgggcagcgtgtggaagcct

SEQ ID NO: 23312 - DNA, 24 bp, Homo sapiens
gagcctgggcagcgtgtggaagcc

SEQ ID NO: 23313 - DNA, 24 bp, Homo sapiens
ggagcctgggcagcgtgtggaagc

SEQ ID NO: 23314 - DNA, 23 bp, Homo sapiens
agttacagcagcagcagcagcag

SEQ ID NO: 23315 - DNA, 23 bp, Homo sapiens
cagaagacagtggtgcctcagcc

SEQ ID NO: 23316 - DNA, 25 bp, Homo sapiens
agccactgactaatccgagaccacc

SEQ ID NO: 23317 - DNA, 24 bp, Homo sapiens
tatctcccaccaggttcctcccac

SEQ ID NO: 23318 - DNA, 24 bp, Homo sapiens
tggcggtggacaagagagaatgag

SEQ ID NO: 23319 - DNA, 24 bp, Homo sapiens
gcctcacaatcatggtggaaggtg

SEQ ID NO: 23320 - DNA, 24 bp, Homo sapiens
ggtgttgaaaggtggacttagtag

SEQ ID NO: 23321 - DNA, 24 bp, Homo sapiens
tggtgttgaaaggtggacttagta

SEQ ID NO: 23322 - DNA, 24 bp, Homo sapiens
ctggtgttgaaaggtggacttagt

SEQ ID NO: 23323 - DNA, 24 bp, Homo sapiens
ctagtggtgtgcttattaatgtgg

SEQ ID NO: 23324 - DNA, 24 bp, Homo sapiens
gctagtggtgtgcttattaatgtg

SEQ ID NO: 23325 - DNA, 24 bp, Homo sapiens
agctagtggtgtgcttattaatgt

SEQ ID NO: 23326 - DNA, 24 bp, Homo sapiens
tgcgaaactgagtgcctgtgtaga

SEQ ID NO: 23327 - DNA, 24 bp, Homo sapiens
ttgcgaaactgagtgcctgtgtag

SEQ ID NO: 23328 - DNA, 24 bp, Homo sapiens
gttgcgaaactgagtgcctgtgta

SEQ ID NO: 23329 - DNA, 25 bp, Homo sapiens
tgatgaccactctcagggaccttga

SEQ ID NO: 23330 - DNA, 25 bp, Homo sapiens
ggtggatggagttcagaggattgtt

SEQ ID NO: 23331 - DNA, 24 bp, Homo sapiens
acttgccaggaggttgtcatagcc

SEQ ID NO: 23332 - DNA, 25 bp, Homo sapiens
tgacatcacttgttagaagagcaac

SEQ ID NO: 23333 - DNA, 23 bp, Homo sapiens
ctttatgtggggtctcattgctc

SEQ ID NO: 23334 - DNA, 23 bp, Homo sapiens
gggccacactggtgtgaatactg

SEQ ID NO: 23335 - DNA, 25 bp, Homo sapiens
aacttcaggctctactacgatggca

SEQ ID NO: 23336 - DNA, 25 bp, Homo sapiens
acgatctggtgactgatggcttgat

SEQ ID NO: 23337 - DNA, 25 bp, Homo sapiens
cacaaccttaaacagagagccagca

SEQ ID NO: 23338 - DNA, 24 bp, Homo sapiens
aaaaagtgcaaagcaaattcgatt

SEQ ID NO: 23339 - DNA, 24 bp, Homo sapiens
gaaaaagtgcaaagcaaattcgat

SEQ ID NO: 23340 - DNA, 24 bp, Homo sapiens
ggaaaaagtgcaaagcaaattcga

SEQ ID NO: 23341 - DNA, 25 bp, Homo sapiens
cagtgttggttaagttgacaaggca

SEQ ID NO: 23342 - DNA, 25 bp, Homo sapiens
gcagaggaacagccagcagaagatg

SEQ ID NO: 23343 - DNA, 25 bp, Homo sapiens
aaggaggatggcaacagaagagtaa

SEQ ID NO: 23344 - DNA, 24 bp, Homo sapiens
ctaaattacatgtatgttttacct

SEQ ID NO: 23345 - DNA, 24 bp, Homo sapiens
tctaaattacatgtatgttttacc

SEQ ID NO: 23346 - DNA, 24 bp, Homo sapiens
gtctaaattacatgtatgttttac

SEQ ID NO: 23347 - DNA, 24 bp, Homo sapiens
gtcaaagaaaggtaaaccaattag

SEQ ID NO: 23348 - DNA, 24 bp, Homo sapiens
tgtcaaagaaaggtaaaccaatta

SEQ ID NO: 23349 - DNA, 24 bp, Homo sapiens
ctgtcaaagaaaggtaaaccaatt

SEQ ID NO: 23350 - DNA, 23 bp, Homo sapiens
ttgtgcctgtggtggtggtgttc

SEQ ID NO: 23351 - DNA, 25 bp, Homo sapiens
gagtgccagccagaagaagaaggtc

SEQ ID NO: 23352 - DNA, 24 bp, Homo sapiens
tctattccctatgcctcccagcgg

SEQ ID NO: 23353 - DNA, 23 bp, Homo sapiens
cacgacaccaccagcaacacctt

SEQ ID NO: 23354 - DNA, 23 bp, Homo sapiens
ccatgctggagactctgcgggag

SEQ ID NO: 23355 - DNA, 23 bp, Homo sapiens
cggtggtgaccctgctggagaag

SEQ ID NO: 23356 - DNA, 23 bp, Homo sapiens
gagacccgccgcctccctccctc

SEQ ID NO: 23357 - DNA, 23 bp, Homo sapiens
aaagccagcagcggcagcgggag

SEQ ID NO: 23358 - DNA, 23 bp, Homo sapiens
tgacttgctccctcccgggctgc

SEQ ID NO: 23359 - DNA, 23 bp, Homo sapiens
ggaagcaccaccatagccaggaa

SEQ ID NO: 23360 - DNA, 25 bp, Homo sapiens
ttgctgaacacatcaactggacaga

SEQ ID NO: 23361 - DNA, 25 bp, Homo sapiens
tccaggcttatgttcaacctcagga

SEQ ID NO: 23362 - DNA, 24 bp, Homo sapiens
tcctcacccagttaatacactgtt

SEQ ID NO: 23363 - DNA, 24 bp, Homo sapiens
ttcctcacccagttaatacactgt

SEQ ID NO: 23364 - DNA, 24 bp, Homo sapiens
cttcctcacccagttaatacactg

SEQ ID NO: 23365 - DNA, 24 bp, Homo sapiens
tgatagggaagatgtttataaatt

SEQ ID NO: 23366 - DNA, 24 bp, Homo sapiens
gtgatagggaagatgtttataaat

SEQ ID NO: 23367 - DNA, 24 bp, Homo sapiens
agtgatagggaagatgtttataaa

SEQ ID NO: 23368 - DNA, 24 bp, Homo sapiens
aaataattcaggtaagagctattt

SEQ ID NO: 23369 - DNA, 24 bp, Homo sapiens
gaaataattcaggtaagagctatt

SEQ ID NO: 23370 - DNA, 24 bp, Homo sapiens
agaaataattcaggtaagagctat

SEQ ID NO: 23371 - DNA, 23 bp, Homo sapiens
atggagaagtgtgaggcggcagc

SEQ ID NO: 23372 - DNA, 24 bp, Homo sapiens
accctcaatcaccatgtcaacgcc

SEQ ID NO: 23373 - DNA, 23 bp, Homo sapiens
acttggcttccctcaagtctatc

SEQ ID NO: 23374 - DNA, 23 bp, Homo sapiens
ttgtgatctgcctgcctcgtcct

SEQ ID NO: 23375 - DNA, 25 bp, Homo sapiens
cggctggattgtcatctcagtagtg

SEQ ID NO: 23376 - DNA, 23 bp, Homo sapiens
atgacatttgggtcagcagtgcc

SEQ ID NO: 23377 - DNA, 24 bp, Homo sapiens
gtggcagcagcagcagctcagaga

SEQ ID NO: 23378 - DNA, 24 bp, Homo sapiens
cgcatctaccgggagacagagaac

SEQ ID NO: 23379 - DNA, 24 bp, Homo sapiens
ccttcagggctccgagacgccagg

SEQ ID NO: 23380 - DNA, 24 bp, Homo sapiens
tagggaatttggtaacattacact

SEQ ID NO: 23381 - DNA, 24 bp, Homo sapiens
atagggaatttggtaacattacac

SEQ ID NO: 23382 - DNA, 24 bp, Homo sapiens
tatagggaatttggtaacattaca

SEQ ID NO: 23383 - DNA, 24 bp, Homo sapiens
tttcatttcagatatttgaagatg

SEQ ID NO: 23384 - DNA, 24 bp, Homo sapiens
ttttcatttcagatatttgaagat

SEQ ID NO: 23385 - DNA, 24 bp, Homo sapiens
tttttcatttcagatatttgaaga

SEQ ID NO: 23386 - DNA, 24 bp, Homo sapiens
ttgggccacagccacttctgacgg

SEQ ID NO: 23387 - DNA, 24 bp, Homo sapiens
gttgggccacagccacttctgacg

SEQ ID NO: 23388 - DNA, 24 bp, Homo sapiens
agttgggccacagccacttctgac

SEQ ID NO: 23389 - DNA, 24 bp, Homo sapiens
ccggccagcagctccaccaaccct

SEQ ID NO: 23390 - DNA, 24 bp, Homo sapiens
cccggccagcagctccaccaaccc

SEQ ID NO: 23391 - DNA, 24 bp, Homo sapiens
gcccggccagcagctccaccaacc

SEQ ID NO: 23392 - DNA, 23 bp, Homo sapiens
gcagcaccgcctcattgagccaa

SEQ ID NO: 23393 - DNA, 25 bp, Homo sapiens
ggactggtttggctactatggaggc

SEQ ID NO: 23394 - DNA, 23 bp, Homo sapiens
agcccatctcagcctcctgcctt

SEQ ID NO: 23395 - DNA, 24 bp, Homo sapiens
acctggtgctggacgagatcaaga

SEQ ID NO: 23396 - DNA, 23 bp, Homo sapiens
gagacggagacggcaatcgcacc

SEQ ID NO: 23397 - DNA, 23 bp, Homo sapiens
caccgtcttccatcacctgccac

SEQ ID NO: 23398 - DNA, 24 bp, Homo sapiens
gccctggctgggggatgggctctt

SEQ ID NO: 23399 - DNA, 24 bp, Homo sapiens
agccctggctgggggatgggctct

SEQ ID NO: 23400 - DNA, 24 bp, Homo sapiens
aagccctggctgggggatgggctc

SEQ ID NO: 23401 - DNA, 23 bp, Homo sapiens
acctatgccttctatcacaacgg

SEQ ID NO: 23402 - DNA, 23 bp, Homo sapiens
gtggctgctcctgctggtggtcg

SEQ ID NO: 23403 - DNA, 23 bp, Homo sapiens
atgtcgctgctgagcctgtcttg

SEQ ID NO: 23404 - DNA, 24 bp, Homo sapiens
tgcaggagcaggccaacgacggca

SEQ ID NO: 23405 - DNA, 24 bp, Homo sapiens
ctgcaggagcaggccaacgacggc

SEQ ID NO: 23406 - DNA, 24 bp, Homo sapiens
tctgcaggagcaggccaacgacgg

SEQ ID NO: 23407 - DNA, 23 bp, Homo sapiens
cctctctgcctccccgagtccag

SEQ ID NO: 23408 - DNA, 23 bp, Homo sapiens
cgccagcccggaggtggttgtcg

SEQ ID NO: 23409 - DNA, 25 bp, Homo sapiens
ttgtcatttctcttgagtaaatacc

SEQ ID NO: 23410 - DNA, 23 bp, Homo sapiens
acgtgtacaggtgtttgtacgga

SEQ ID NO: 23411 - DNA, 25 bp, Homo sapiens
tttggctattataaataaaatagtg

SEQ ID NO: 23412 - DNA, 23 bp, Homo sapiens
tcgctttggacttcgggcttgtg

SEQ ID NO: 23413 - DNA, 23 bp, Homo sapiens
gtcggtggtggacatgcacacgg

SEQ ID NO: 23414 - DNA, 24 bp, Homo sapiens
cacaacgagggctacagctccatg

SEQ ID NO: 23415 - DNA, 23 bp, Homo sapiens
aagacctatgtcggcggcatcct

SEQ ID NO: 23416 - DNA, 23 bp, Homo sapiens
ctatggctttcctgaggctgggc

SEQ ID NO: 23417 - DNA, 24 bp, Homo sapiens
gagcagcaacagcacggactacat

SEQ ID NO: 23418 - DNA, 23 bp, Homo sapiens
ctatggctttcctgaggctgggc

SEQ ID NO: 23419 - DNA, 24 bp, Homo sapiens
gagcagcaacagcacggactacat

SEQ ID NO: 23420 - DNA, 25 bp, Homo sapiens
ctgagcactgggaagaagacgcatc

SEQ ID NO: 23421 - DNA, 23 bp, Homo sapiens
tggagtgcctcaatgaacagcgg

SEQ ID NO: 23422 - DNA, 23 bp, Homo sapiens
acgtgtcagtggtggtcaagggc

SEQ ID NO: 23423 - DNA, 25 bp, Homo sapiens
ccagtctttccagcagatcctcagc

SEQ ID NO: 23424 - DNA, 24 bp, Homo sapiens
tttaaatttagtttttgatgatga

SEQ ID NO: 23425 - DNA, 24 bp, Homo sapiens
ttttaaatttagtttttgatgatg

SEQ ID NO: 23426 - DNA, 24 bp, Homo sapiens
cttttaaatttagtttttgatgat

SEQ ID NO: 23427 - DNA, 24 bp, Homo sapiens
agagagaaatggtagtgaattagt

SEQ ID NO: 23428 - DNA, 24 bp, Homo sapiens
aagagagaaatggtagtgaattag

SEQ ID NO: 23429 - DNA, 24 bp, Homo sapiens
caagagagaaatggtagtgaatta

SEQ ID NO: 23430 - DNA, 24 bp, Homo sapiens
taattgatcagattttaacctacc

SEQ ID NO: 23431 - DNA, 24 bp, Homo sapiens
ataattgatcagattttaacctac

SEQ ID NO: 23432 - DNA, 24 bp, Homo sapiens
tataattgatcagattttaaccta

SEQ ID NO: 23433 - DNA, 24 bp, Homo sapiens
ttctcttccaggtggtatcagcct

SEQ ID NO: 23434 - DNA, 24 bp, Homo sapiens
cttctcttccaggtggtatcagcc

SEQ ID NO: 23435 - DNA, 24 bp, Homo sapiens
tcttctcttccaggtggtatcagc

SEQ ID NO: 23436 - DNA, 25 bp, Homo sapiens
accagacaaggaaaccaaagccaca

SEQ ID NO: 23437 - DNA, 23 bp, Homo sapiens
gcaaagccagcccagaccctcag

SEQ ID NO: 23438 - DNA, 25 bp, Homo sapiens
catcaagctgttcgttctgtgccac

SEQ ID NO: 23439 - DNA, 24 bp, Homo sapiens
ggtccactcctctgtcctatgccg

SEQ ID NO: 23440 - DNA, 24 bp, Homo sapiens
gaccgtagagattatgtcactgtt

SEQ ID NO: 23441 - DNA, 24 bp, Homo sapiens
ttgttacataactcagttcctggt

SEQ ID NO: 23442 - DNA, 24 bp, Homo sapiens
ctgtagaacagttgatcccgctct

SEQ ID NO: 23443 - DNA, 24 bp, Homo sapiens
cctgtagaacagttgatcccgctc

SEQ ID NO: 23444 - DNA, 24 bp, Homo sapiens
tcctgtagaacagttgatcccgct

SEQ ID NO: 23445 - DNA, 24 bp, Homo sapiens
ctcttctccagacacccagtgcgg

SEQ ID NO: 23446 - DNA, 24 bp, Homo sapiens
cctcttctccagacacccagtgcg

SEQ ID NO: 23447 - DNA, 24 bp, Homo sapiens
ccctcttctccagacacccagtgc

SEQ ID NO: 23448 - DNA, 23 bp, Homo sapiens
aggacctggacgaggatgccacc

SEQ ID NO: 23449 - DNA, 24 bp, Homo sapiens
cgcctccatctatctccacgacca

SEQ ID NO: 23450 - DNA, 23 bp, Homo sapiens
agagatgagcaggagcgtggacg

SEQ ID NO: 23451 - DNA, 24 bp, Homo sapiens
aaaaagatgcagtaagttaattcc

SEQ ID NO: 23452 - DNA, 24 bp, Homo sapiens
gaaaaagatgcagtaagttaattc

SEQ ID NO: 23453 - DNA, 24 bp, Homo sapiens
tgaaaaagatgcagtaagttaatt

SEQ ID NO: 23454 - DNA, 24 bp, Homo sapiens
aagaacaggagtttcaatagtcat

SEQ ID NO: 23455 - DNA, 24 bp, Homo sapiens
gaagaacaggagtttcaatagtca

SEQ ID NO: 23456 - DNA, 24 bp, Homo sapiens
ggaagaacaggagtttcaatagtc

SEQ ID NO: 23457 - DNA, 24 bp, Homo sapiens
tatcttttcaggtaaaatgtttca

SEQ ID NO: 23458 - DNA, 24 bp, Homo sapiens
atatcttttcaggtaaaatgtttc

SEQ ID NO: 23459 - DNA, 24 bp, Homo sapiens
aatatcttttcaggtaaaatgttt

SEQ ID NO: 23460 - DNA, 24 bp, Homo sapiens
aggaacaaaaggtaaattttaaaa

SEQ ID NO: 23461 - DNA, 24 bp, Homo sapiens
gaggaacaaaaggtaaattttaaa

SEQ ID NO: 23462 - DNA, 24 bp, Homo sapiens
agaggaacaaaaggtaaattttaa

SEQ ID NO: 23463 - DNA, 24 bp, Homo sapiens
gtggtgggtgtctctgctgttctg

SEQ ID NO: 23464 - DNA, 25 bp, Homo sapiens
cctgactcgttcaatgagcctggtg

SEQ ID NO: 23465 - DNA, 23 bp, Homo sapiens
tgtccaacatgctctatgcctgc

SEQ ID NO: 23466 - DNA, 24 bp, Homo sapiens
gggagagcaggatgggggctccgg

SEQ ID NO: 23467 - DNA, 24 bp, Homo sapiens
tgggagagcaggatgggggctccg

SEQ ID NO: 23468 - DNA, 24 bp, Homo sapiens
gtgggagagcaggatgggggctcc

SEQ ID NO: 23469 - DNA, 23 bp, Homo sapiens
gctcagatatgcctgcgtgctgg

SEQ ID NO: 23470 - DNA, 24 bp, Homo sapiens
ctccagcgtgctctcctacttcct

SEQ ID NO: 23471 - DNA, 23 bp, Homo sapiens
cctcctgctgctgctgctggtgg

SEQ ID NO: 23472 - DNA, 23 bp, Homo sapiens
gccatcaccgtcttctgctcctg

SEQ ID NO: 23473 - DNA, 24 bp, Homo sapiens
ccgcctccagcaggacaatattcg

SEQ ID NO: 23474 - DNA, 23 bp, Homo sapiens
cttgtgtggctgctgtgtctggg

SEQ ID NO: 23475 - DNA, 23 bp, Homo sapiens
tctctgcctgctaccatcaccag

SEQ ID NO: 23476 - DNA, 23 bp, Homo sapiens
cccaccgtgtccctgcttgatgg

SEQ ID NO: 23477 - DNA, 23 bp, Homo sapiens
cctgctgccacatctgcccactg

SEQ ID NO: 23478 - DNA, 24 bp, Homo sapiens
gaagaaaatgcctattttgaagat

SEQ ID NO: 23479 - DNA, 24 bp, Homo sapiens
tgaagaaaatgcctattttgaaga

SEQ ID NO: 23480 - DNA, 24 bp, Homo sapiens
atgaagaaaatgcctattttgaag

SEQ ID NO: 23481 - DNA, 24 bp, Homo sapiens
ccccttgaaagcaacatctacagt

SEQ ID NO: 23482 - DNA, 24 bp, Homo sapiens
accccttgaaagcaacatctacag

SEQ ID NO: 23483 - DNA, 24 bp, Homo sapiens
taccccttgaaagcaacatctaca

SEQ ID NO: 23484 - DNA, 25 bp, Homo sapiens
actcactgtagccttgacctcctgg

SEQ ID NO: 23485 - DNA, 23 bp, Homo sapiens
cccaggctagagtacagtggtgc

SEQ ID NO: 23486 - DNA, 24 bp, Homo sapiens
caagaatgaagccgcagaccgtcg

SEQ ID NO: 23487 - DNA, 24 bp, Homo sapiens
agatgtggaggtggaagacagtga

SEQ ID NO: 23488 - DNA, 24 bp, Homo sapiens
ccttcttgtgggttctcggtctca

SEQ ID NO: 23489 - DNA, 24 bp, Homo sapiens
tcccaccacagcccagcaggaggc

SEQ ID NO: 23490 - DNA, 24 bp, Homo sapiens
ctcccaccacagcccagcaggagg

SEQ ID NO: 23491 - DNA, 24 bp, Homo sapiens
tctcccaccacagcccagcaggag

SEQ ID NO: 23492 - DNA, 23 bp, Homo sapiens
gaggcaggcatcttccaggaggc

SEQ ID NO: 23493 - DNA, 25 bp, Homo sapiens
gctgggcatcatacttgtcactggg

SEQ ID NO: 23494 - DNA, 23 bp, Homo sapiens
gcccacttaccgcaggatgaagc

SEQ ID NO: 23495 - DNA, 24 bp, Homo sapiens
aggtggttgggctgtgtggccgcc

SEQ ID NO: 23496 - DNA, 24 bp, Homo sapiens
caggtggttgggctgtgtggccgc

SEQ ID NO: 23497 - DNA, 24 bp, Homo sapiens
ccaggtggttgggctgtgtggccg

SEQ ID NO: 23498 - DNA, 24 bp, Homo sapiens
catcgtcgaaggaggccatgatgg

SEQ ID NO: 23499 - DNA, 24 bp, Homo sapiens
ccatcgtcgaaggaggccatgatg

SEQ ID NO: 23500 - DNA, 24 bp, Homo sapiens
accatcgtcgaaggaggccatgat

SEQ ID NO: 23501 - DNA, 24 bp, Homo sapiens
ataactcccccgtgcggctgaaga

SEQ ID NO: 23502 - DNA, 24 bp, Homo sapiens
gataactcccccgtgcggctgaag

SEQ ID NO: 23503 - DNA, 24 bp, Homo sapiens
tgataactcccccgtgcggctgaa

SEQ ID NO: 23504 - DNA, 23 bp, Homo sapiens
actgcgtggtcaacatcctctct

SEQ ID NO: 23505 - DNA, 24 bp, Homo sapiens
cggaaggtgctgatgaagacaggc

SEQ ID NO: 23506 - DNA, 23 bp, Homo sapiens
ctggtggtgctgggccatgtgag

SEQ ID NO: 23507 - DNA, 24 bp, Homo sapiens
aaatctcgaagttgcacatgattg

SEQ ID NO: 23508 - DNA, 24 bp, Homo sapiens
aaaatctcgaagttgcacatgatt

SEQ ID NO: 23509 - DNA, 24 bp, Homo sapiens
aaaaatctcgaagttgcacatgat

SEQ ID NO: 23510 - DNA, 24 bp, Homo sapiens
ggcccttacttgctgctgagctct

SEQ ID NO: 23511 - DNA, 24 bp, Homo sapiens
tggcccttacttgctgctgagctc

SEQ ID NO: 23512 - DNA, 24 bp, Homo sapiens
ttggcccttacttgctgctgagct

SEQ ID NO: 23513 - DNA, 24 bp, Homo sapiens
cctgggttcaagcgattctcctgc

SEQ ID NO: 23514 - DNA, 24 bp, Homo sapiens
aacatccgatcaagaacctgggct

SEQ ID NO: 23515 - DNA, 24 bp, Homo sapiens
tccaatcttcaacaacctgttagg

SEQ ID NO: 23516 - DNA, 23 bp, Homo sapiens
gctgtcccgccctgaaatgcaat

SEQ ID NO: 23517 - DNA, 23 bp, Homo sapiens
ggcggcatcaggaactttaccat

SEQ ID NO: 23518 - DNA, 23 bp, Homo sapiens
ggcaggagacctctgtccagcag

SEQ ID NO: 23519 - DNA, 24 bp, Homo sapiens
tgccgccgctgctgctgcttctgg

SEQ ID NO: 23520 - DNA, 24 bp, Homo sapiens
tagggggccccggagcgccgcggc

SEQ ID NO: 23521 - DNA, 24 bp, Homo sapiens
gcgctgtccagagaccacctccca

SEQ ID NO: 23522 - DNA, 24 bp, Homo sapiens
tgcgctgtccagagaccacctccc

SEQ ID NO: 23523 - DNA, 24 bp, Homo sapiens
ctgcgctgtccagagaccacctcc

SEQ ID NO: 23524 - DNA, 25 bp, Homo sapiens
agtcacggctcagttaagagattga

SEQ ID NO: 23525 - DNA, 23 bp, Homo sapiens
gactccctgtgtgtcttagccgc

SEQ ID NO: 23526 - DNA, 23 bp, Homo sapiens
caccagccctcccgcctcccgtc

SEQ ID NO: 23527 - DNA, 24 bp, Homo sapiens
caaagagccctaccccgatgtcac

SEQ ID NO: 23528 - DNA, 24 bp, Homo sapiens
ttaccgtcttcatgctgctcgtgg

SEQ ID NO: 23529 - DNA, 24 bp, Homo sapiens
cctctcggtggtggtgacggtgat

SEQ ID NO: 23530 - DNA, 24 bp, Homo sapiens
cgccagggcagggaagtcagacct

SEQ ID NO: 23531 - DNA, 24 bp, Homo sapiens
gcgccagggcagggaagtcagacc

SEQ ID NO: 23532 - DNA, 24 bp, Homo sapiens
ggcgccagggcagggaagtcagac

SEQ ID NO: 23533 - DNA, 24 bp, Homo sapiens
gtcaattccgggaggtgtatgtgg

SEQ ID NO: 23534 - DNA, 24 bp, Homo sapiens
ggtcaattccgggaggtgtatgtg

SEQ ID NO: 23535 - DNA, 24 bp, Homo sapiens
tggtcaattccgggaggtgtatgt

SEQ ID NO: 23536 - DNA, 24 bp, Homo sapiens
cacatcctggggtcttggtggcac

SEQ ID NO: 23537 - DNA, 24 bp, Homo sapiens
gcacatcctggggtcttggtggca

SEQ ID NO: 23538 - DNA, 24 bp, Homo sapiens
ggcacatcctggggtcttggtggc

SEQ ID NO: 23539 - DNA, 24 bp, Homo sapiens
cgctcaatccttctccgtggcttc

SEQ ID NO: 23540 - DNA, 24 bp, Homo sapiens
gcagcatggtgtgaagttcctacg

SEQ ID NO: 23541 - DNA, 24 bp, Homo sapiens
agtggtgggtgcctcttatgttgc

SEQ ID NO: 23542 - DNA, 24 bp, Homo sapiens
ttgtagatgtggatgaaaagaatc

SEQ ID NO: 23543 - DNA, 24 bp, Homo sapiens
cttgtagatgtggatgaaaagaat

SEQ ID NO: 23544 - DNA, 24 bp, Homo sapiens
gcttgtagatgtggatgaaaagaa

SEQ ID NO: 23545 - DNA, 24 bp, Homo sapiens
caattatttaggtatttttagaaa

SEQ ID NO: 23546 - DNA, 24 bp, Homo sapiens
tcaattatttaggtatttttagaa

SEQ ID NO: 23547 - DNA, 24 bp, Homo sapiens
tcaattatttaggtatttttagaa

SEQ ID NO: 23548 - DNA, 24 bp, Homo sapiens
ttctggaatccttcaaggcaagtt

SEQ ID NO: 23549 - DNA, 24 bp, Homo sapiens
ccagtaaggcaccagtcttaactt

SEQ ID NO: 23550 - DNA, 24 bp, Homo sapiens
caacagttgggataggcggagacc

SEQ ID NO: 23551 - DNA, 24 bp, Homo sapiens
gcatcaccgtcaacaccaccatct

SEQ ID NO: 23552 - DNA, 24 bp, Homo sapiens
gctgctgctgttgctgctgctgag

SEQ ID NO: 23553 - DNA, 24 bp, Homo sapiens
tgaggtcacttcaccgtggtctcc

SEQ ID NO: 23554 - DNA, 24 bp, Homo sapiens
caggtgttggaattagacaactgc

SEQ ID NO: 23555 - DNA, 24 bp, Homo sapiens
tcaggtgttggaattagacaactg

SEQ ID NO: 23556 - DNA, 24 bp, Homo sapiens
ttcaggtgttggaattagacaact

SEQ ID NO: 23557 - DNA, 23 bp, Homo sapiens
ccgagagtggaagtgacgcagtt

SEQ ID NO: 23558 - DNA, 25 bp, Homo sapiens
tgccgatcaatgagccagatgaagg

SEQ ID NO: 23559 - DNA, 23 bp, Homo sapiens
aataacaaggctgggtgcggtgg

SEQ ID NO: 23560 - DNA, 24 bp, Homo sapiens
catccagcaccgaccagccaagat

SEQ ID NO: 23561 - DNA, 24 bp, Homo sapiens
tgtcgccatcctcatccacttcct

SEQ ID NO: 23562 - DNA, 24 bp, Homo sapiens
ccagaagtgtaccgtcgccatcaa

SEQ ID NO: 23563 - DNA, 24 bp, Homo sapiens
ttgcagtatatgtaagttacaaat

SEQ ID NO: 23564 - DNA, 24 bp, Homo sapiens
tttgcagtatatgtaagttacaaa

SEQ ID NO: 23565 - DNA, 24 bp, Homo sapiens
ttttgcagtatatgtaagttacaa

SEQ ID NO: 23566 - DNA, 24 bp, Homo sapiens
ggaggtggcaggccagtgccagga

SEQ ID NO: 23567 - DNA, 24 bp, Homo sapiens
aggaggtggcaggccagtgccagg

SEQ ID NO: 23568 - DNA, 24 bp, Homo sapiens
gaggaggtggcaggccagtgccag

SEQ ID NO: 23569 - DNA, 24 bp, Homo sapiens
aagcacgtcaaaattctccgctat

SEQ ID NO: 23570 - DNA, 24 bp, Homo sapiens
aaagcacgtcaaaattctccgcta

SEQ ID NO: 23571 - DNA, 24 bp, Homo sapiens
caaagcacgtcaaaattctccgct

SEQ ID NO: 23572 - DNA, 23 bp, Homo sapiens
gccttcttcaccatgctctacgg

SEQ ID NO: 23573 - DNA, 23 bp, Homo sapiens
cctggtgggctggctcctggtag

SEQ ID NO: 23574 - DNA, 23 bp, Homo sapiens
gctccctcaggtggctcatctcc

SEQ ID NO: 23575 - DNA, 24 bp, Homo sapiens
cggcaacaccaccacctctacaat

SEQ ID NO: 23576 - DNA, 25 bp, Homo sapiens
ggctcgctaccgtacaatctgatcc

SEQ ID NO: 23577 - DNA, 25 bp, Homo sapiens
ttggagcttggacaggacctattga

SEQ ID NO: 23578 - DNA, 25 bp, Homo sapiens
gccagacaatgacaaggagttacgc

SEQ ID NO: 23579 - DNA, 23 bp, Homo sapiens
ctgccgccgcctgactctgctgt

SEQ ID NO: 23580 - DNA, 23 bp, Homo sapiens
atgtgggtcttgctgggctctgt

SEQ ID NO: 23581 - DNA, 24 bp, Homo sapiens
ccttcgtggagagcatgttcgtca

SEQ ID NO: 23582 - DNA, 23 bp, Homo sapiens
gccttcttcaccatgctctacgg

SEQ ID NO: 23583 - DNA, 23 bp, Homo sapiens
cctggtgggctggctcctggtag

SEQ ID NO: 23584 - DNA, 24 bp, Homo sapiens
acaagagtcactcggacatcggct

SEQ ID NO: 23585 - DNA, 25 bp, Homo sapiens
tcctcatcagcaccagcaactacct

SEQ ID NO: 23586 - DNA, 23 bp, Homo sapiens
ggtttaccacgggacccaggttc

SEQ ID NO: 23587 - DNA, 23 bp, Homo sapiens
cggtcggtgatggtggtcaggat

SEQ ID NO: 23588 - DNA, 25 bp, Homo sapiens
tgtggctcctcttccagactgatgg

SEQ ID NO: 23589 - DNA, 25 bp, Homo sapiens
ggtccaagcggatcacctgtatgaa

SEQ ID NO: 23590 - DNA, 23 bp, Homo sapiens
cggtcggtgatggtggtcaggat

SEQ ID NO: 23591 - DNA, 24 bp, Homo sapiens
acatcctgacaggtacatcggtcc

SEQ ID NO: 23592 - DNA, 25 bp, Homo sapiens
tgtggctcctcttccagactgatgg

SEQ ID NO: 23593 - DNA, 25 bp, Homo sapiens
atgacttcctccatatctacgacgg

SEQ ID NO: 23594 - DNA, 23 bp, Homo sapiens
cagcagcaacagcctcttcctcg

SEQ ID NO: 23595 - DNA, 23 bp, Homo sapiens
tccatcaagaacggcacacgggt

SEQ ID NO: 23596 - DNA, 23 bp, Homo sapiens
cacaccagcaccgcctctacttg

SEQ ID NO: 23597 - DNA, 24 bp, Homo sapiens
ggcttcaggtctcaaggttcacaa

SEQ ID NO: 23598 - DNA, 25 bp, Homo sapiens
agactcgtttaagcagactcccagc

SEQ ID NO: 23599 - DNA, 24 bp, Homo sapiens
tatctgtagaggtaaaatgaaaac

SEQ ID NO: 23600 - DNA, 24 bp, Homo sapiens
ctatctgtagaggtaaaatgaaaa

SEQ ID NO: 23601 - DNA, 24 bp, Homo sapiens
cctatctgtagaggtaaaatgaaa

SEQ ID NO: 23602 - DNA, 24 bp, Homo sapiens
taactacaaaggaaatataatttc

SEQ ID NO: 23603 - DNA, 24 bp, Homo sapiens
ttaactacaaaggaaatataattt

SEQ ID NO: 23604 - DNA, 24 bp, Homo sapiens
gttaactacaaaggaaatataatt

SEQ ID NO: 23605 - DNA, 24 bp, Homo sapiens
tcggatttcaacccacagctgtaa

SEQ ID NO: 23606 - DNA, 24 bp, Homo sapiens
ttcggatttcaacccacagctgta

SEQ ID NO: 23607 - DNA, 24 bp, Homo sapiens
attcggatttcaacccacagctgt

SEQ ID NO: 23608 - DNA, 23 bp, Homo sapiens
ggatctgagtggcatagagctgg

SEQ ID NO: 23609 - DNA, 23 bp, Homo sapiens
ctgtgtgctgctgccccgagatg

SEQ ID NO: 23610 - DNA, 23 bp, Homo sapiens
gccagagcctgcggctagagtgg

SEQ ID NO: 23611 - DNA, 24 bp, Homo sapiens
ctttccccattgtgagtatatcat

SEQ ID NO: 23612 - DNA, 24 bp, Homo sapiens
cctttccccattgtgagtatatca

SEQ ID NO: 23613 - DNA, 24 bp, Homo sapiens
tcctttccccattgtgagtatatc

SEQ ID NO: 23614 - DNA, 24 bp, Homo sapiens
tccaacttcagaatttatgaaaaa

SEQ ID NO: 23615 - DNA, 24 bp, Homo sapiens
gtccaacttcagaatttatgaaaa

SEQ ID NO: 23616 - DNA, 24 bp, Homo sapiens
ggtccaacttcagaatttatgaaa

SEQ ID NO: 23617 - DNA, 24 bp, Homo sapiens
atttaacacatatactacaataac

SEQ ID NO: 23618 - DNA, 24 bp, Homo sapiens
catttaacacatatactacaataa

SEQ ID NO: 23619 - DNA, 24 bp, Homo sapiens
tcatttaacacatatactacaata

SEQ ID NO: 23620 - DNA, 24 bp, Homo sapiens
aactttgcaaggttggtagaatac

SEQ ID NO: 23621 - DNA, 24 bp, Homo sapiens
taactttgcaaggttggtagaata

SEQ ID NO: 23622 - DNA, 24 bp, Homo sapiens
ttaactttgcaaggttggtagaat

SEQ ID NO: 23623 - DNA, 24 bp, Homo sapiens
tagattttatggtggcttctatgc

SEQ ID NO: 23624 - DNA, 24 bp, Homo sapiens
atagattttatggtggcttctatg

SEQ ID NO: 23625 - DNA, 24 bp, Homo sapiens
catagattttatggtggcttctat

SEQ ID NO: 23626 - DNA, 24 bp, Homo sapiens
ctttattgcaggaaatctacaaag

SEQ ID NO: 23627 - DNA, 24 bp, Homo sapiens
actttattgcaggaaatctacaaa

SEQ ID NO: 23628 - DNA, 24 bp, Homo sapiens
gactttattgcaggaaatctacaa

SEQ ID NO: 23629 - DNA, 24 bp, Homo sapiens
tattatcacagccttaaagaagaa

SEQ ID NO: 23630 - DNA, 24 bp, Homo sapiens
atattatcacagccttaaagaaga

SEQ ID NO: 23631 - DNA, 24 bp, Homo sapiens
gatattatcacagccttaaagaag

SEQ ID NO: 23632 - DNA, 24 bp, Homo sapiens
tgaattatcagaacaaaagccctt

SEQ ID NO: 23633 - DNA, 24 bp, Homo sapiens
atgaattatcagaacaaaagccct

SEQ ID NO: 23634 - DNA, 24 bp, Homo sapiens
catgaattatcagaacaaaagccc

SEQ ID NO: 23635 - DNA, 24 bp, Homo sapiens
aatcgctcagttacaggacggcag

SEQ ID NO: 23636 - DNA, 24 bp, Homo sapiens
cactgaccttgtgaccgagttcat

SEQ ID NO: 23637 - DNA, 24 bp, Homo sapiens
aagcgatgacgaggacgatgagga

SEQ ID NO: 23638 - DNA, 24 bp, Homo sapiens
ctcagacggcaggcacaggaggac

SEQ ID NO: 23639 - DNA, 24 bp, Homo sapiens
gaggaggcagtggaggaagtggag

SEQ ID NO: 23640 - DNA, 24 bp, Homo sapiens
gaacagcaaaggcacccgcatcca

SEQ ID NO: 23641 - DNA, 25 bp, Homo sapiens
agcaactggtggagtgataactggc

SEQ ID NO: 23642 - DNA, 23 bp, Homo sapiens
atgtcaacctcagcccgtctcct

SEQ ID NO: 23643 - DNA, 24 bp, Homo sapiens
gcagatgttgtggttgttcgtggc

SEQ ID NO: 23644 - DNA, 25 bp, Homo sapiens
ggcatcagaatcacctggaggactt

SEQ ID NO: 23645 - DNA, 25 bp, Homo sapiens
ggcagcattactccatctgaactct

SEQ ID NO: 23646 - DNA, 25 bp, Homo sapiens
gctcacaggttataccagtgttgct

SEQ ID NO: 23647 - DNA, 24 bp, Homo sapiens
ctaaataccaggtattacatgtat

SEQ ID NO: 23648 - DNA, 24 bp, Homo sapiens
gctaaataccaggtattacatgta

SEQ ID NO: 23649 - DNA, 24 bp, Homo sapiens
agctaaataccaggtattacatgt

SEQ ID NO: 23650 - DNA, 24 bp, Homo sapiens
gcaaaaatcatgctaaatttggcc

SEQ ID NO: 23651 - DNA, 24 bp, Homo sapiens
agcaaaaatcatgctaaatttggc

SEQ ID NO: 23652 - DNA, 24 bp, Homo sapiens
cagcaaaaatcatgctaaatttgg

SEQ ID NO: 23653 - DNA, 24 bp, Homo sapiens
tgtatcaatagctacattcccaaa

SEQ ID NO: 23654 - DNA, 24 bp, Homo sapiens
ttgtatcaatagctacattcccaa

SEQ ID NO: 23655 - DNA, 24 bp, Homo sapiens
cttgtatcaatagctacattccca

SEQ ID NO: 23656 - DNA, 24 bp, Homo sapiens
agattagaagggtaagtttgcatt

SEQ ID NO: 23657 - DNA, 24 bp, Homo sapiens
aagattagaagggtaagtttgcat

SEQ ID NO: 23658 - DNA, 24 bp, Homo sapiens
taagattagaagggtaagtttgca

SEQ ID NO: 23659 - DNA, 25 bp, Homo sapiens
tcaagttcaacatccagaagcgacc

SEQ ID NO: 23660 - DNA, 23 bp, Homo sapiens
gctttggctccaacgcagagggc

SEQ ID NO: 23661 - DNA, 23 bp, Homo sapiens
gtggttttggcccccagcccaac

SEQ ID NO: 23662 - DNA, 24 bp, Homo sapiens
tctgttttcagacgtgtcttaaag

SEQ ID NO: 23663 - DNA, 24 bp, Homo sapiens
ttctgttttcagacgtgtcttaaa

SEQ ID NO: 23664 - DNA, 24 bp, Homo sapiens
tttctgttttcagacgtgtcttaa

SEQ ID NO: 23665 - DNA, 24 bp, Homo sapiens
tctcttttcagatgttaaaattca

SEQ ID NO: 23666 - DNA, 24 bp, Homo sapiens
ttctcttttcagatgttaaaattc

SEQ ID NO: 23667 - DNA, 24 bp, Homo sapiens
tttctcttttcagatgttaaaatt

SEQ ID NO: 23668 - DNA, 24 bp, Homo sapiens
ctcccaggcacccagcactttaag

SEQ ID NO: 23669 - DNA, 23 bp, Homo sapiens
gccttaatgctaaagccaaatgc

SEQ ID NO: 23670 - DNA, 23 bp, Homo sapiens
agccactgtgacggggagtccag

SEQ ID NO: 23671 - DNA, 24 bp, Homo sapiens
gctgttcattaaccacatcctcaa

SEQ ID NO: 23672 - DNA, 23 bp, Homo sapiens
cctggttcctgctctgcgtgttc

SEQ ID NO: 23673 - DNA, 23 bp, Homo sapiens
ctccacggcacgggcagcacagg

SEQ ID NO: 23674 - DNA, 24 bp, Homo sapiens
tttaaatataggatagtgaagttt

SEQ ID NO: 23675 - DNA, 24 bp, Homo sapiens
ttttaaatataggatagtgaagtt

SEQ ID NO: 23676 - DNA, 24 bp, Homo sapiens
tttttaaatataggatagtgaagt

SEQ ID NO: 23677 - DNA, 24 bp, Homo sapiens
aacagagaaagaaaattgaaactc

SEQ ID NO: 23678 - DNA, 24 bp, Homo sapiens
gaacagagaaagaaaattgaaact

SEQ ID NO: 23679 - DNA, 24 bp, Homo sapiens
tgaacagagaaagaaaattgaaac

SEQ ID NO: 23680 - DNA, 24 bp, Homo sapiens
tgctcgtcttaccacttgtattag

SEQ ID NO: 23681 - DNA, 23 bp, Homo sapiens
tgggctgccataacaaaatacca

SEQ ID NO: 23682 - DNA, 25 bp, Homo sapiens
ccatcagccagtgccaacataacct

SEQ ID NO: 23683 - DNA, 25 bp, Homo sapiens
tccaagtcacattccacagagcagc

SEQ ID NO: 23684 - DNA, 25 bp, Homo sapiens
gcctcaacttgttacagcagagtgt

SEQ ID NO: 23685 - DNA, 23 bp, Homo sapiens
ggtagcaacagcagcagccgcag

SEQ ID NO: 23686 - DNA, 23 bp, Homo sapiens
gagagggcagtccagggcacaga

SEQ ID NO: 23687 - DNA, 23 bp, Homo sapiens
ctcctcgccctcctgctctctgg

SEQ ID NO: 23688 - DNA, 24 bp, Homo sapiens
cggagaggaaggtccacctggccg

SEQ ID NO: 23689 - DNA, 24 bp, Homo sapiens
gcggagaggaaggtccacctggcc

SEQ ID NO: 23690 - DNA, 24 bp, Homo sapiens
agcggagaggaaggtccacctggc

SEQ ID NO: 23691 - DNA, 25 bp, Homo sapiens
caggaatgatgggacgaatgggctt

SEQ ID NO: 23692 - DNA, 23 bp, Homo sapiens
ccaagatggacacgacggcgacc

SEQ ID NO: 23693 - DNA, 23 bp, Homo sapiens
ctgtgctgctgacccactgcttg

SEQ ID NO: 23694 - DNA, 23 bp, Homo sapiens
ctgtggtggctgacggctgtgac

SEQ ID NO: 23695 - DNA, 25 bp, Homo sapiens
ttgacatccttagcgtccgtctctg

SEQ ID NO: 23696 - DNA, 24 bp, Homo sapiens
taaagataattgggagtacaattg

SEQ ID NO: 23697 - DNA, 24 bp, Homo sapiens
ataaagataattgggagtacaatt

SEQ ID NO: 23698 - DNA, 24 bp, Homo sapiens
aataaagataattgggagtacaat

SEQ ID NO: 23699 - DNA, 24 bp, Homo sapiens
gcaggacccaggcacagacagaac

SEQ ID NO: 23700 - DNA, 24 bp, Homo sapiens
ggcaggacccaggcacagacagaa

SEQ ID NO: 23701 - DNA, 24 bp, Homo sapiens
aggcaggacccaggcacagacaga

SEQ ID NO: 23702 - DNA, 24 bp, Homo sapiens
tttaatttcagttctgtattaact

SEQ ID NO: 23703 - DNA, 24 bp, Homo sapiens
ttttaatttcagttctgtattaac

SEQ ID NO: 23704 - DNA, 24 bp, Homo sapiens
attttaatttcagttctgtattaa

SEQ ID NO: 23705 - DNA, 24 bp, Homo sapiens
cggcaccagcgtgtcctatatcac

SEQ ID NO: 23706 - DNA, 23 bp, Homo sapiens
ccagagtgagccaccagcctccg

SEQ ID NO: 23707 - DNA, 25 bp, Homo sapiens
catcctggacatgagtggagtcagc

SEQ ID NO: 23708 - DNA, 25 bp, Homo sapiens
cttcaacaatgccaccaatgagagc

SEQ ID NO: 23709 - DNA, 23 bp, Homo sapiens
tagcctgcctcaccgccatcatc

SEQ ID NO: 23710 - DNA, 25 bp, Homo sapiens
gccatctacctctccgagtccttca

SEQ ID NO: 23711 - DNA, 25 bp, Homo sapiens
tcggtgctcaagtacatcttcggac

SEQ ID NO: 23712 - DNA, 25 bp, Homo sapiens
gccatctacctctccgagtccttca

SEQ ID NO: 23713 - DNA, 23 bp, Homo sapiens
tagcctgcctcaccgccatcatc

SEQ ID NO: 23714 - DNA, 24 bp, Homo sapiens
atttagttttgattattgctgcat

SEQ ID NO: 23715 - DNA, 24 bp, Homo sapiens
gatttagttttgattattgctgca

SEQ ID NO: 23716 - DNA, 24 bp, Homo sapiens
agatttagttttgattattgctgc

SEQ ID NO: 23717 - DNA, 25 bp, Homo sapiens
aaggcaggagtgtggatgtattgtt

SEQ ID NO: 23718 - DNA, 23 bp, Homo sapiens
gagtctccatgcttgttgaggtt

SEQ ID NO: 23719 - DNA, 24 bp, Homo sapiens
agtcctgccctaatgagaagtgtt

SEQ ID NO: 23720 - DNA, 24 bp, Homo sapiens
cgggagctgccgacggacggagcg

SEQ ID NO: 23721 - DNA, 24 bp, Homo sapiens
cgcccccgcccggccgcccgcccg

SEQ ID NO: 23722 - DNA, 23 bp, Homo sapiens
atgttcacgcagcagcagccgca

SEQ ID NO: 23723 - DNA, 24 bp, Homo sapiens
ggcttcctcttccgctacatcctg

SEQ ID NO: 23724 - DNA, 23 bp, Homo sapiens
ccgacatcgtggagctgaacgtg

SEQ ID NO: 23725 - DNA, 24 bp, Homo sapiens
tcgtgcttccatatatgtttaata

SEQ ID NO: 23726 - DNA, 24 bp, Homo sapiens
ttcgtgcttccatatatgtttaat

SEQ ID NO: 23727 - DNA, 24 bp, Homo sapiens
cttcgtgcttccatatatgtttaa

SEQ ID NO: 23728 - DNA, 24 bp, Homo sapiens
agtccttaaaagtaagtttctcag

SEQ ID NO: 23729 - DNA, 24 bp, Homo sapiens
gagtccttaaaagtaagtttctca

SEQ ID NO: 23730 - DNA, 24 bp, Homo sapiens
ggagtccttaaaagtaagtttctc

SEQ ID NO: 23731 - DNA, 25 bp, Homo sapiens
ggaagtggtcaagttctcagcctca

SEQ ID NO: 23732 - DNA, 24 bp, Homo sapiens
tagcgactggactactgcctgacg

SEQ ID NO: 23733 - DNA, 24 bp, Homo sapiens
cagtggctcacacctgtggaatcc

SEQ ID NO: 23734 - DNA, 23 bp, Homo sapiens
gtgagccccgccgcctccgccag

SEQ ID NO: 23735 - DNA, 23 bp, Homo sapiens
ctgcccgcccggcggcgactgcg

SEQ ID NO: 23736 - DNA, 24 bp, Homo sapiens
atatgaaaatgcagaaaccctggg

SEQ ID NO: 23737 - DNA, 24 bp, Homo sapiens
tatatgaaaatgcagaaaccctgg

SEQ ID NO: 23738 - DNA, 24 bp, Homo sapiens
atatatgaaaatgcagaaaccctg

SEQ ID NO: 23739 - DNA, 24 bp, Homo sapiens
tggataaacaggtatgacgaatag

SEQ ID NO: 23740 - DNA, 24 bp, Homo sapiens
ctggataaacaggtatgacgaata

SEQ ID NO: 23741 - DNA, 24 bp, Homo sapiens
actggataaacaggtatgacgaat

SEQ ID NO: 23742 - DNA, 24 bp, Homo sapiens
tgtggtggccagtgggtgcatcct

SEQ ID NO: 23743 - DNA, 24 bp, Homo sapiens
gtgtggtggccagtgggtgcatcc

SEQ ID NO: 23744 - DNA, 24 bp, Homo sapiens
ggtgtggtggccagtgggtgcatc

SEQ ID NO: 23745 - DNA, 24 bp, Homo sapiens
cacggttgctggtggcctggctgc

SEQ ID NO: 23746 - DNA, 24 bp, Homo sapiens
acacggttgctggtggcctggctg

SEQ ID NO: 23747 - DNA, 24 bp, Homo sapiens
tacacggttgctggtggcctggct

SEQ ID NO: 23748 - DNA, 25 bp, Homo sapiens
gcggtgctagttctgtacttcctct

SEQ ID NO: 23749 - DNA, 24 bp, Homo sapiens
cagccctcagcctccacagttaga

SEQ ID NO: 23750 - DNA, 23 bp, Homo sapiens
gatccagaggtctcgttcaggac

SEQ ID NO: 23751 - DNA, 23 bp, Homo sapiens
tgatgatggctgtgatggtggcg

SEQ ID NO: 23752 - DNA, 23 bp, Homo sapiens
atggacctctggaatcacctccg

SEQ ID NO: 23753 - DNA, 23 bp, Homo sapiens
ttgtgctgctgctggtcctggtc

SEQ ID NO: 23754 - DNA, 23 bp, Homo sapiens
gctgtgatggtggcggctctcat

SEQ ID NO: 23755 - DNA, 24 bp, Homo sapiens
cctcacctccatctttaacagtgc

SEQ ID NO: 23756 - DNA, 23 bp, Homo sapiens
ccggcctcgggcatctgagaagg

SEQ ID NO: 23757 - DNA, 23 bp, Homo sapiens
cctgtggcggtggtcttcatcat

SEQ ID NO: 23758 - DNA, 23 bp, Homo sapiens
ttgtgctgctgctggtcctggtc

SEQ ID NO: 23759 - DNA, 23 bp, Homo sapiens
atggacctctggaatcacctccg

SEQ ID NO: 23760 - DNA, 23 bp, Homo sapiens
cagcagcagcagcgtccagttcg

SEQ ID NO: 23761 - DNA, 24 bp, Homo sapiens
cctctctcagaacgggatgccaga

SEQ ID NO: 23762 - DNA, 23 bp, Homo sapiens
ggaacaagcaccaccagcagctc

SEQ ID NO: 23763 - DNA, 24 bp, Homo sapiens
tttggaaaagggtgacattgtgat

SEQ ID NO: 23764 - DNA, 24 bp, Homo sapiens
atttggaaaagggtgacattgtga

SEQ ID NO: 23765 - DNA, 24 bp, Homo sapiens
aatttggaaaagggtgacattgtg

SEQ ID NO: 23766 - DNA, 23 bp, Homo sapiens
ggctggatggagtgtggtggcat

SEQ ID NO: 23767 - DNA, 24 bp, Homo sapiens
ttgtccttggtcttacagccagaa

SEQ ID NO: 23768 - DNA, 23 bp, Homo sapiens
tgatcctcccacctcagcctcct

SEQ ID NO: 23769 - DNA, 23 bp, Homo sapiens
gaactcctctcgcctcagcctct

SEQ ID NO: 23770 - DNA, 24 bp, Homo sapiens
tctcattctgctgctcaggctgga

SEQ ID NO: 23771 - DNA, 24 bp, Homo sapiens
caggtcacatctgttcttcagcaa

SEQ ID NO: 23772 - DNA, 25 bp, Homo sapiens
gatgactttcgttccctggatgccc

SEQ ID NO: 23773 - DNA, 25 bp, Homo sapiens
ggtgcatatttgaccggaggttctc

SEQ ID NO: 23774 - DNA, 23 bp, Homo sapiens
cggagcttcccccgccccccgag

SEQ ID NO: 23775 - DNA, 24 bp, Homo sapiens
tggagacactgtcaggactggtgg

SEQ ID NO: 23776 - DNA, 23 bp, Homo sapiens
ggcctgtgctcacctggatggag

SEQ ID NO: 23777 - DNA, 24 bp, Homo sapiens
gaaaattctagttacagaagctta

SEQ ID NO: 23778 - DNA, 24 bp, Homo sapiens
tgaaaattctagttacagaagctt

SEQ ID NO: 23779 - DNA, 24 bp, Homo sapiens
ttgaaaattctagttacagaagct

SEQ ID NO: 23780 - DNA, 24 bp, Homo sapiens
atgacggagaaggagcagcagcag

SEQ ID NO: 23781 - DNA, 24 bp, Homo sapiens
tggcatctggcacaatgacaacaa

SEQ ID NO: 23782 - DNA, 24 bp, Homo sapiens
gacgggcgagttcaaagggaagta

SEQ ID NO: 23783 - DNA, 24 bp, Homo sapiens
atgacggagaaggagcagcagcag

SEQ ID NO: 23784 - DNA, 24 bp, Homo sapiens
tgaccacttcctgttcgacaagcc

SEQ ID NO: 23785 - DNA, 24 bp, Homo sapiens
tggcatctggcacaatgacaacaa

SEQ ID NO: 23786 - DNA, 24 bp, Homo sapiens
ctgcgtggctggtgatgaggagtc

SEQ ID NO: 23787 - DNA, 24 bp, Homo sapiens
tccatctggcttcactgtagacga

SEQ ID NO: 23788 - DNA, 24 bp, Homo sapiens
cccgacctcagcaaacataacaac

SEQ ID NO: 23789 - DNA, 25 bp, Homo sapiens
gaacgtccttagactcttgctcagc

SEQ ID NO: 23790 - DNA, 24 bp, Homo sapiens
aatccagcctctcaccacttatgc

SEQ ID NO: 23791 - DNA, 23 bp, Homo sapiens
agaccgcctcctttccatagagc

SEQ ID NO: 23792 - DNA, 23 bp, Homo sapiens
ccgtgatcgtgcccaaagaggag

SEQ ID NO: 23793 - DNA, 23 bp, Homo sapiens
aagcctctgacccgcaagccgat

SEQ ID NO: 23794 - DNA, 23 bp, Homo sapiens
tctcaacctgtgtccgtgctcca

SEQ ID NO: 23795 - DNA, 24 bp, Homo sapiens
ctcaaggacttcttcgtgcggctc

SEQ ID NO: 23796 - DNA, 24 bp, Homo sapiens
gcaacaatagcgaccaggacgagc

SEQ ID NO: 23797 - DNA, 24 bp, Homo sapiens
ctggtgctgctgttctttggtgct

SEQ ID NO: 23798 - DNA, 24 bp, Homo sapiens
agcaaacacatctgagcctggaaa

SEQ ID NO: 23799 - DNA, 24 bp, Homo sapiens
ccgagaaaacgcagagggcatcct

SEQ ID NO: 23800 - DNA, 24 bp, Homo sapiens
cccacacccagcaccaccaacagg

SEQ ID NO: 23801 - DNA, 24 bp, Homo sapiens
attacgtgctgtcttctcgggtgc

SEQ ID NO: 23802 - DNA, 24 bp, Homo sapiens
ccgagcgaagggaggtagagaacg

SEQ ID NO: 23803 - DNA, 24 bp, Homo sapiens
gacctggctggccgctactacaag

SEQ ID NO: 23804 - DNA, 23 bp, Homo sapiens
ctcctggacaacagcacggctca

SEQ ID NO: 23805 - DNA, 23 bp, Homo sapiens
cctcctggctatttccatcccgc

SEQ ID NO: 23806 - DNA, 23 bp, Homo sapiens
accagtgccgccgcttccgccag

SEQ ID NO: 23807 - DNA, 24 bp, Homo sapiens
tgttgaatcagcaaacactgctca

SEQ ID NO: 23808 - DNA, 24 bp, Homo sapiens
ctgttgaatcagcaaacactgctc

SEQ ID NO: 23809 - DNA, 24 bp, Homo sapiens
gctgttgaatcagcaaacactgct

SEQ ID NO: 23810 - DNA, 24 bp, Homo sapiens
tgctccagcagctacaggagtact

SEQ ID NO: 23811 - DNA, 24 bp, Homo sapiens
atgctccagcagctacaggagtac

SEQ ID NO: 23812 - DNA, 24 bp, Homo sapiens
catgctccagcagctacaggagta

SEQ ID NO: 23813 - DNA, 24 bp, Homo sapiens
atcaagtgctgcctggatgaagat

SEQ ID NO: 23814 - DNA, 24 bp, Homo sapiens
gcgattgctgtgattggagctgga

SEQ ID NO: 23815 - DNA, 25 bp, Homo sapiens
cccacctgctttgaaagaaatgatg

SEQ ID NO: 23816 - DNA, 24 bp, Homo sapiens
gcggccaccaggaccccagccagg

SEQ ID NO: 23817 - DNA, 24 bp, Homo sapiens
cgcggccaccaggaccccagccag

SEQ ID NO: 23818 - DNA, 24 bp, Homo sapiens
ccgcggccaccaggaccccagcca

SEQ ID NO: 23819 - DNA, 24 bp, Homo sapiens
ccagtggtgaagaagcagacgctg

SEQ ID NO: 23820 - DNA, 23 bp, Homo sapiens
ctgctgcccactccgccacccaa

SEQ ID NO: 23821 - DNA, 23 bp, Homo sapiens
gacctctggagagatccgtgggc

SEQ ID NO: 23822 - DNA, 24 bp, Homo sapiens
ctttgggaaggagacacagtggcc

SEQ ID NO: 23823 - DNA, 24 bp, Homo sapiens
actttgggaaggagacacagtggc

SEQ ID NO: 23824 - DNA, 24 bp, Homo sapiens
gactttgggaaggagacacagtgg

SEQ ID NO: 23825 - DNA, 23 bp, Homo sapiens
aacctgctcgtctccttcgctca

SEQ ID NO: 23826 - DNA, 23 bp, Homo sapiens
ctctgtcgcctgcccctacccgt

SEQ ID NO: 23827 - DNA, 23 bp, Homo sapiens
ccagaacagacctaggaggcggc

SEQ ID NO: 23828 - DNA, 24 bp, Homo sapiens
tcctttttcaggtaatgtgtcagt

SEQ ID NO: 23829 - DNA, 24 bp, Homo sapiens
ttcctttttcaggtaatgtgtcag

SEQ ID NO: 23830 - DNA, 24 bp, Homo sapiens
attcctttttcaggtaatgtgtca

SEQ ID NO: 23831 - DNA, 24 bp, Homo sapiens
ttgagtccatccacagccctaccc

SEQ ID NO: 23832 - DNA, 25 bp, Homo sapiens
aacagcagcaacagcaacataagaa

SEQ ID NO: 23833 - DNA, 25 bp, Homo sapiens
gtgaagatagtggctctagtcctgc

SEQ ID NO: 23834 - DNA, 24 bp, Homo sapiens
gtgccaggcttcaaggagacaacc

SEQ ID NO: 23835 - DNA, 24 bp, Homo sapiens
gccaaggtcacactgaacatctgt

SEQ ID NO: 23836 - DNA, 25 bp, Homo sapiens
aacagcagcaacagcaacataagaa

SEQ ID NO: 23837 - DNA, 24 bp, Homo sapiens
ggattattcaggacataattaatt

SEQ ID NO: 23838 - DNA, 24 bp, Homo sapiens
gggattattcaggacataattaat

SEQ ID NO: 23839 - DNA, 24 bp, Homo sapiens
tgggattattcaggacataattaa

SEQ ID NO: 23840 - DNA, 23 bp, Homo sapiens
cgctgctgtcgcctcctctgatg

SEQ ID NO: 23841 - DNA, 23 bp, Homo sapiens
gcggcacctgcggctcctctaag

SEQ ID NO: 23842 - DNA, 23 bp, Homo sapiens
ggaggagcagagacccgcagccg

SEQ ID NO: 23843 - DNA, 24 bp, Homo sapiens
tctcactctgtcacgaggctggag

SEQ ID NO: 23844 - DNA, 25 bp, Homo sapiens
gccaagcagttgaccacttagttct

SEQ ID NO: 23845 - DNA, 23 bp, Homo sapiens
ggagtagctgggaccacaggcaa

SEQ ID NO: 23846 - DNA, 24 bp, Homo sapiens
ctactactcggacaagtacttcga

SEQ ID NO: 23847 - DNA, 24 bp, Homo sapiens
gctcttcgcgctctcgtttcattt

SEQ ID NO: 23848 - DNA, 24 bp, Homo sapiens
ttgttgcctgggctggacgtggtt

SEQ ID NO: 23849 - DNA, 24 bp, Homo sapiens
cttcccagcccaactctcccaccc

SEQ ID NO: 23850 - DNA, 24 bp, Homo sapiens
ctgatgttatcggtctgactcgca

SEQ ID NO: 23851 - DNA, 24 bp, Homo sapiens
cactgtctgcttctatgggatgcc

SEQ ID NO: 23852 - DNA, 24 bp, Homo sapiens
cctaagactcccagaggctgatgc

SEQ ID NO: 23853 - DNA, 24 bp, Homo sapiens
ctgctccaggggcttcattgctcc

SEQ ID NO: 23854 - DNA, 24 bp, Homo sapiens
cagacccgcctccgcccggctccc

SEQ ID NO: 23855 - DNA, 23 bp, Homo sapiens
gcagtggaacgatctcggctcac

SEQ ID NO: 23856 - DNA, 23 bp, Homo sapiens
ccgaggcgtacatcaagaagagc

SEQ ID NO: 23857 - DNA, 23 bp, Homo sapiens
gcttccgcttcggcaccgtgtgg

SEQ ID NO: 23858 - DNA, 23 bp, Homo sapiens
acatgcacgcacacatgcggcgc

SEQ ID NO: 23859 - DNA, 23 bp, Homo sapiens
ctgacgctgctcggggaggtccc

SEQ ID NO: 23860 - DNA, 23 bp, Homo sapiens
tggtgcggctgctgcggctccgg

SEQ ID NO: 23861 - DNA, 23 bp, Homo sapiens
gggtgtcccgggctcgcgcagga

SEQ ID NO: 23862 - DNA, 24 bp, Homo sapiens
ggttggaaagagtggacaaaccca

SEQ ID NO: 23863 - DNA, 24 bp, Homo sapiens
aggttggaaagagtggacaaaccc

SEQ ID NO: 23864 - DNA, 24 bp, Homo sapiens
gaggttggaaagagtggacaaacc

SEQ ID NO: 23865 - DNA, 24 bp, Homo sapiens
tgtggtggcaggcacctgtaatcc

SEQ ID NO: 23866 - DNA, 24 bp, Homo sapiens
gtgtggtggcaggcacctgtaatc

SEQ ID NO: 23867 - DNA, 24 bp, Homo sapiens
ggtgtggtggcaggcacctgtaat

SEQ ID NO: 23868 - DNA, 24 bp, Homo sapiens
ttggaaactatgtaagtataaagt

SEQ ID NO: 23869 - DNA, 24 bp, Homo sapiens
tttggaaactatgtaagtataaag

SEQ ID NO: 23870 - DNA, 24 bp, Homo sapiens
atttggaaactatgtaagtataaa

SEQ ID NO: 23871 - DNA, 24 bp, Homo sapiens
tgggaacactgattatgctataga

SEQ ID NO: 23872 - DNA, 24 bp, Homo sapiens
ttgggaacactgattatgctatag

SEQ ID NO: 23873 - DNA, 24 bp, Homo sapiens
attgggaacactgattatgctata

SEQ ID NO: 23874 - DNA, 23 bp, Homo sapiens
aggctgcgtgcggtggctcatac

SEQ ID NO: 23875 - DNA, 23 bp, Homo sapiens
ggaggctgaggcaggcggatcac

SEQ ID NO: 23876 - DNA, 25 bp, Homo sapiens
cgtcttcaggaacagagatttcatc

SEQ ID NO: 23877 - DNA, 23 bp, Homo sapiens
ggattgctggctgctggatgtca

SEQ ID NO: 23878 - DNA, 25 bp, Homo sapiens
ggatgtatgtgctgccagtggagac

SEQ ID NO: 23879 - DNA, 25 bp, Homo sapiens
tggtgtccacataatcctgatctgt

SEQ ID NO: 23880 - DNA, 25 bp, Homo sapiens
atggaacaaggatgtatgtgctgcc

SEQ ID NO: 23881 - DNA, 23 bp, Homo sapiens
gtgggattgctggctgctggatg

SEQ ID NO: 23882 - DNA, 25 bp, Homo sapiens
acaggtttgcatattgtgcgaccct

SEQ ID NO: 23883 - DNA, 23 bp, Homo sapiens
ttcgctttgaacccaagaggctg

SEQ ID NO: 23884 - DNA, 25 bp, Homo sapiens
gtctacaccaactcatcgaacacct

SEQ ID NO: 23885 - DNA, 25 bp, Homo sapiens
ggctccagacacctttgacgatacc

SEQ ID NO: 23886 - DNA, 25 bp, Homo sapiens
cgctgtgaatcagatctatgaggcc

SEQ ID NO: 23887 - DNA, 23 bp, Homo sapiens
gagggtgcaggcagcaggaaacc

SEQ ID NO: 23888 - DNA, 24 bp, Homo sapiens
caaattcttagagacaaataaaaa

SEQ ID NO: 23889 - DNA, 24 bp, Homo sapiens
tcaaattcttagagacaaataaaa

SEQ ID NO: 23890 - DNA, 24 bp, Homo sapiens
ttcaaattcttagagacaaataaa

SEQ ID NO: 23891 - DNA, 24 bp, Homo sapiens
tttaaacaaaggtttaggatgcaa

SEQ ID NO: 23892 - DNA, 24 bp, Homo sapiens
ttttaaacaaaggtttaggatgca

SEQ ID NO: 23893 - DNA, 24 bp, Homo sapiens
tttttaaacaaaggtttaggatgc

SEQ ID NO: 23894 - DNA, 24 bp, Homo sapiens
aggatgtgaagagtagtaaacatg

SEQ ID NO: 23895 - DNA, 24 bp, Homo sapiens
aaggatgtgaagagtagtaaacat

SEQ ID NO: 23896 - DNA, 24 bp, Homo sapiens
caaggatgtgaagagtagtaaaca

SEQ ID NO: 23897 - DNA, 24 bp, Homo sapiens
aactgcgcctgggtgtgctgggcg

SEQ ID NO: 23898 - DNA, 24 bp, Homo sapiens
gaactgcgcctgggtgtgctgggc

SEQ ID NO: 23899 - DNA, 24 bp, Homo sapiens
tgaactgcgcctgggtgtgctggg

SEQ ID NO: 23900 - DNA, 25 bp, Homo sapiens
cggaaggtggcaggttcaagaaaga

SEQ ID NO: 23901 - DNA, 25 bp, Homo sapiens
acacgagcgagattcctctggttct

SEQ ID NO: 23902 - DNA, 25 bp, Homo sapiens
ccaggatgccataagttctgctaac

SEQ ID NO: 23903 - DNA, 25 bp, Homo sapiens
aatttgtggtggtgtccctcactgg

SEQ ID NO: 23904 - DNA, 23 bp, Homo sapiens
gtggcacttcgaggcttcaacgg

SEQ ID NO: 23905 - DNA, 23 bp, Homo sapiens
ccgcagtgccaaggacaagactc

SEQ ID NO: 23906 - DNA, 24 bp, Homo sapiens
ttcatataaacacccaaagcttat

SEQ ID NO: 23907 - DNA, 24 bp, Homo sapiens
cttcatataaacacccaaagctta

SEQ ID NO: 23908 - DNA, 24 bp, Homo sapiens
ccttcatataaacacccaaagctt

SEQ ID NO: 23909 - DNA, 25 bp, Homo sapiens
agggttgctctgtgattctatgtct

SEQ ID NO: 23910 - DNA, 24 bp, Homo sapiens
atctccctatgttgctcaggctgc

SEQ ID NO: 23911 - DNA, 23 bp, Homo sapiens
tggtctcgaactcctgggctcaa

SEQ ID NO: 23912 - DNA, 25 bp, Homo sapiens
gctggtaactatcttcctgctggtg

SEQ ID NO: 23913 - DNA, 23 bp, Homo sapiens
actttgtatggcaagtggaacca

SEQ ID NO: 23914 - DNA, 25 bp, Homo sapiens
tggtggattttgctagatttttctg

SEQ ID NO: 23915 - DNA, 24 bp, Homo sapiens
ttctttccaagattgatgtacttc

SEQ ID NO: 23916 - DNA, 24 bp, Homo sapiens
tttctttccaagattgatgtactt

SEQ ID NO: 23917 - DNA, 24 bp, Homo sapiens
atttctttccaagattgatgtact

SEQ ID NO: 23918 - DNA, 24 bp, Homo sapiens
caaaaagtgagttggcttcagctg

SEQ ID NO: 23919 - DNA, 24 bp, Homo sapiens
tcaaaaagtgagttggcttcagct

SEQ ID NO: 23920 - DNA, 24 bp, Homo sapiens
ctcaaaaagtgagttggcttcagc

SEQ ID NO: 23921 - DNA, 24 bp, Homo sapiens
gggccgtgacgatgaggaaagtga

SEQ ID NO: 23922 - DNA, 24 bp, Homo sapiens
ggggccgtgacgatgaggaaagtg

SEQ ID NO: 23923 - DNA, 24 bp, Homo sapiens
gggggccgtgacgatgaggaaagt

SEQ ID NO: 23924 - DNA, 24 bp, Homo sapiens
caaaacttaaggtgcaaaaattac

SEQ ID NO: 23925 - DNA, 24 bp, Homo sapiens
tcaaaacttaaggtgcaaaaatta

SEQ ID NO: 23926 - DNA, 24 bp, Homo sapiens
ctcaaaacttaaggtgcaaaaatt

SEQ ID NO: 23927 - DNA, 24 bp, Homo sapiens
agtgctggtcttcctcctctgtgg

SEQ ID NO: 23928 - DNA, 25 bp, Homo sapiens
cctggagtggatgttctgtgacttc

SEQ ID NO: 23929 - DNA, 25 bp, Homo sapiens
ctgctggtcaggattctctgtggat

SEQ ID NO: 23930 - DNA, 24 bp, Homo sapiens
gaattgaagaggaagaaaaagaag

SEQ ID NO: 23931 - DNA, 24 bp, Homo sapiens
ggaattgaagaggaagaaaaagaa

SEQ ID NO: 23932 - DNA, 24 bp, Homo sapiens
cggaattgaagaggaagaaaaaga

SEQ ID NO: 23933 - DNA, 25 bp, Homo sapiens
gtgggtgctgctgttggatttgttg

SEQ ID NO: 23934 - DNA, 25 bp, Homo sapiens
tgcccaatagtcagcgtcttcacag

SEQ ID NO: 23935 - DNA, 25 bp, Homo sapiens
cggctccaaagacgatgacaagatg

SEQ ID NO: 23936 - DNA, 23 bp, Homo sapiens
caggcaggagcaggtgattcttc

SEQ ID NO: 23937 - DNA, 24 bp, Homo sapiens
cagcacaccagcaggaaggagatt

SEQ ID NO: 23938 - DNA, 23 bp, Homo sapiens
cacaacactggacttgggctctg

SEQ ID NO: 23939 - DNA, 25 bp, Homo sapiens
aggattgcccaggtattctctgagg

SEQ ID NO: 23940 - DNA, 23 bp, Homo sapiens
tccccgcgacctcaaggcttact

SEQ ID NO: 23941 - DNA, 23 bp, Homo sapiens
gacatgttttccgtgatgagtga

SEQ ID NO: 23942 - DNA, 24 bp, Homo sapiens
gctgctggatggtgaggctggcgg

SEQ ID NO: 23943 - DNA, 24 bp, Homo sapiens
agctgctggatggtgaggctggcg

SEQ ID NO: 23944 - DNA, 24 bp, Homo sapiens
gagctgctggatggtgaggctggc

SEQ ID NO: 23945 - DNA, 24 bp, Homo sapiens
agatgaaaatgcaagctttggaga

SEQ ID NO: 23946 - DNA, 24 bp, Homo sapiens
aagatgaaaatgcaagctttggag

SEQ ID NO: 23947 - DNA, 24 bp, Homo sapiens
gaagatgaaaatgcaagctttgga

SEQ ID NO: 23948 - DNA, 23 bp, Homo sapiens
gtggcaacgtcctcgctctgatc

SEQ ID NO: 23949 - DNA, 25 bp, Homo sapiens
ttattgctggtgctgggacttggag

SEQ ID NO: 23950 - DNA, 25 bp, Homo sapiens
ttgtgaggctgacagtctctgatgt

SEQ ID NO: 23951 - DNA, 23 bp, Homo sapiens
cagtggtgcgatctcggctctct

SEQ ID NO: 23952 - DNA, 24 bp, Homo sapiens
ctttctttcacaagccctccagga

SEQ ID NO: 23953 - DNA, 25 bp, Homo sapiens
gaaactatgagggcagaacccagca

SEQ ID NO: 23954 - DNA, 24 bp, Homo sapiens
attaataaagagagataccttccc

SEQ ID NO: 23955 - DNA, 24 bp, Homo sapiens
aattaataaagagagataccttcc

SEQ ID NO: 23956 - DNA, 24 bp, Homo sapiens
caattaataaagagagataccttc

SEQ ID NO: 23957 - DNA, 24 bp, Homo sapiens
ggaggaagcaggattaggcagaga

SEQ ID NO: 23958 - DNA, 23 bp, Homo sapiens
gctgcctcagaagagtgtggact

SEQ ID NO: 23959 - DNA, 24 bp, Homo sapiens
tttcagaagtgggtaacagtagcc

SEQ ID NO: 23960 - DNA, 24 bp, Homo sapiens
aacaaataaaggtaagttcatagt

SEQ ID NO: 23961 - DNA, 24 bp, Homo sapiens
caacaaataaaggtaagttcatag

SEQ ID NO: 23962 - DNA, 24 bp, Homo sapiens
tcaacaaataaaggtaagttcata

SEQ ID NO: 23963 - DNA, 24 bp, Homo sapiens
actctcgccagaatgaatcccgga

SEQ ID NO: 23964 - DNA, 24 bp, Homo sapiens
cactctcgccagaatgaatcccgg

SEQ ID NO: 23965 - DNA, 24 bp, Homo sapiens
ccactctcgccagaatgaatcccg

SEQ ID NO: 23966 - DNA, 24 bp, Homo sapiens
gaagttggaatcctgtgagaagcg

SEQ ID NO: 23967 - DNA, 24 bp, Homo sapiens
ggaggagcagcaactagatgaacc

SEQ ID NO: 23968 - DNA, 24 bp, Homo sapiens
ctcacactatcttctcactgctgg

SEQ ID NO: 23969 - DNA, 24 bp, Homo sapiens
cgatctcgccgtggactggatgac

SEQ ID NO: 23970 - DNA, 24 bp, Homo sapiens
tgttgctggacttctaacgagacc

SEQ ID NO: 23971 - DNA, 24 bp, Homo sapiens
acgctggtgctggtagtgtcctcc

SEQ ID NO: 23972 - DNA, 23 bp, Homo sapiens
ggtgccttacatctgtgccgagc

SEQ ID NO: 23973 - DNA, 23 bp, Homo sapiens
ccagaggctgaagcaggactacc

SEQ ID NO: 23974 - DNA, 25 bp, Homo sapiens
gatgagcagcaccagcagtaagagg

SEQ ID NO: 23975 - DNA, 23 bp, Homo sapiens
tcgccatccacacctgccagttc

SEQ ID NO: 23976 - DNA, 25 bp, Homo sapiens
ctgaactgttagactccagactgcc

SEQ ID NO: 23977 - DNA, 23 bp, Homo sapiens
cctggttcgtcagtggatcacgg

SEQ ID NO: 23978 - DNA, 24 bp, Homo sapiens
ggcctcccaaagtgctgggactac

SEQ ID NO: 23979 - DNA, 24 bp, Homo sapiens
tggcctcccaaagtgctgggacta

SEQ ID NO: 23980 - DNA, 24 bp, Homo sapiens
ttggcctcccaaagtgctgggact

SEQ ID NO: 23981 - DNA, 23 bp, Homo sapiens
ctgctgctggaggacggtggctc

SEQ ID NO: 23982 - DNA, 24 bp, Homo sapiens
tggagatgtacgacctggtggtgg

SEQ ID NO: 23983 - DNA, 23 bp, Homo sapiens
cgctcatgcctgtgctgaatcag

SEQ ID NO: 23984 - DNA, 24 bp, Homo sapiens
aacaactcaaggtaaaacattcac

SEQ ID NO: 23985 - DNA, 24 bp, Homo sapiens
gaacaactcaaggtaaaacattca

SEQ ID NO: 23986 - DNA, 24 bp, Homo sapiens
agaacaactcaaggtaaaacattc

SEQ ID NO: 23987 - DNA, 24 bp, Homo sapiens
gcagtggtcagttttcagaagcga

SEQ ID NO: 23988 - DNA, 24 bp, Homo sapiens
tgcagtggtcagttttcagaagcg

SEQ ID NO: 23989 - DNA, 24 bp, Homo sapiens
ctgcagtggtcagttttcagaagc

SEQ ID NO: 23990 - DNA, 24 bp, Homo sapiens
ctgtttcaaaggtgcgtggatgtg

SEQ ID NO: 23991 - DNA, 24 bp, Homo sapiens
cctgtttcaaaggtgcgtggatgt

SEQ ID NO: 23992 - DNA, 24 bp, Homo sapiens
gcctgtttcaaaggtgcgtggatg

SEQ ID NO: 23993 - DNA, 24 bp, Homo sapiens
gggagcctgagaacaagagcaagc

SEQ ID NO: 23994 - DNA, 24 bp, Homo sapiens
ggggagcctgagaacaagagcaag

SEQ ID NO: 23995 - DNA, 24 bp, Homo sapiens
cggggagcctgagaacaagagcaa

SEQ ID NO: 23996 - DNA, 23 bp, Homo sapiens
atggaggctgacctgtctggctt

SEQ ID NO: 23997 - DNA, 25 bp, Homo sapiens
gcactgtctttgtatctgagcggga

SEQ ID NO: 23998 - DNA, 25 bp, Homo sapiens
aaggtgatggtggagaagagcagga

SEQ ID NO: 23999 - DNA, 24 bp, Homo sapiens
tgagccctgaggctggagtgcaac

SEQ ID NO: 24000 - DNA, 24 bp, Homo sapiens
ctgagccctgaggctggagtgcaa

SEQ ID NO: 24001 - DNA, 24 bp, Homo sapiens
cctgagccctgaggctggagtgca

SEQ ID NO: 24002 - DNA, 24 bp, Homo sapiens
tacaagatcaggtttaagccgttt

SEQ ID NO: 24003 - DNA, 24 bp, Homo sapiens
ttacaagatcaggtttaagccgtt

SEQ ID NO: 24004 - DNA, 24 bp, Homo sapiens
attacaagatcaggtttaagccgt

SEQ ID NO: 24005 - DNA, 24 bp, Homo sapiens
ttattctgcaggttactcattttt

SEQ ID NO: 24006 - DNA, 24 bp, Homo sapiens
tttattctgcaggttactcatttt

SEQ ID NO: 24007 - DNA, 24 bp, Homo sapiens
ttttattctgcaggttactcattt

SEQ ID NO: 24008 - DNA, 23 bp, Homo sapiens
tcagcaaggagcaggaccacttc

SEQ ID NO: 24009 - DNA, 25 bp, Homo sapiens
ctaccgactcctggacctctatggc

SEQ ID NO: 24010 - DNA, 25 bp, Homo sapiens
tgacgcctatcaatgacctccacac

SEQ ID NO: 24011 - DNA, 24 bp, Homo sapiens
agacgattcagaggagacggtgcc

SEQ ID NO: 24012 - DNA, 24 bp, Homo sapiens
tgagacaggacaggaacgagagcc

SEQ ID NO: 24013 - DNA, 23 bp, Homo sapiens
gtgtgcgagttcttcagcgttgc

SEQ ID NO: 24014 - DNA, 24 bp, Homo sapiens
acattattaaaatagggtcttgct

SEQ ID NO: 24015 - DNA, 24 bp, Homo sapiens
aacattattaaaatagggtcttgc

SEQ ID NO: 24016 - DNA, 24 bp, Homo sapiens
gaacattattaaaatagggtcttg

SEQ ID NO: 24017 - DNA, 24 bp, Homo sapiens
tcatggagcaggttcatcgtggca

SEQ ID NO: 24018 - DNA, 24 bp, Homo sapiens
ttcatggagcaggttcatcgtggc

SEQ ID NO: 24019 - DNA, 24 bp, Homo sapiens
gttcatggagcaggttcatcgtgg

SEQ ID NO: 24020 - DNA, 23 bp, Homo sapiens
cctccctcaaccccgatggctac

SEQ ID NO: 24021 - DNA, 23 bp, Homo sapiens
ggagctgctgctgctgctggtgc

SEQ ID NO: 24022 - DNA, 24 bp, Homo sapiens
tgtcaggagtacttggcccggaat

SEQ ID NO: 24023 - DNA, 24 bp, Homo sapiens
aacctgaagatggaactgaatgct

SEQ ID NO: 24024 - DNA, 25 bp, Homo sapiens
cattaacgggagtttggaagaagcc

SEQ ID NO: 24025 - DNA, 24 bp, Homo sapiens
gggttcaagacttcagtggaggaa

SEQ ID NO: 24026 - DNA, 24 bp, Homo sapiens
ggcgtgattaccactcctcctcct

SEQ ID NO: 24027 - DNA, 25 bp, Homo sapiens
ccagaatacattagggagaggaaca

SEQ ID NO: 24028 - DNA, 25 bp, Homo sapiens
gacttcaacatgatggagcagagga

SEQ ID NO: 24029 - DNA, 24 bp, Homo sapiens
agagaaataagactatgcaatttg

SEQ ID NO: 24030 - DNA, 24 bp, Homo sapiens
aagagaaataagactatgcaattt

SEQ ID NO: 24031 - DNA, 24 bp, Homo sapiens
aaagagaaataagactatgcaatt

SEQ ID NO: 24032 - DNA, 24 bp, Homo sapiens
cctgcctccagcccctatgtcacc

SEQ ID NO: 24033 - DNA, 24 bp, Homo sapiens
ccctgcctccagcccctatgtcac

SEQ ID NO: 24034 - DNA, 24 bp, Homo sapiens
tccctgcctccagcccctatgtca

SEQ ID NO: 24035 - DNA, 23 bp, Homo sapiens
tgctgctgctgctcggattcctc

SEQ ID NO: 24036 - DNA, 23 bp, Homo sapiens
ccgggtcgcgtccctccctgagc

SEQ ID NO: 24037 - DNA, 23 bp, Homo sapiens
cggcggccatgctgccccgaggg

SEQ ID NO: 24038 - DNA, 24 bp, Homo sapiens
gtgggcttctggctgctgggcctt

SEQ ID NO: 24039 - DNA, 24 bp, Homo sapiens
ggtgggcttctggctgctgggcct

SEQ ID NO: 24040 - DNA, 24 bp, Homo sapiens
cggtgggcttctggctgctgggcc

SEQ ID NO: 24041 - DNA, 24 bp, Homo sapiens
cagcctgtgtggtgtggtcttcgc

SEQ ID NO: 24042 - DNA, 24 bp, Homo sapiens
ccagcctgtgtggtgtggtcttcg

SEQ ID NO: 24043 - DNA, 24 bp, Homo sapiens
accagcctgtgtggtgtggtcttc

SEQ ID NO: 24044 - DNA, 24 bp, Homo sapiens
tattttcacaggcgagttaaaaac

SEQ ID NO: 24045 - DNA, 24 bp, Homo sapiens
ttattttcacaggcgagttaaaaa

SEQ ID NO: 24046 - DNA, 24 bp, Homo sapiens
tttattttcacaggcgagttaaaa

SEQ ID NO: 24047 - DNA, 24 bp, Homo sapiens
tgacatagttggtaagttcgagtc

SEQ ID NO: 24048 - DNA, 24 bp, Homo sapiens
ttgacatagttggtaagttcgagt

SEQ ID NO: 24049 - DNA, 24 bp, Homo sapiens
tttgacatagttggtaagttcgag

SEQ ID NO: 24050 - DNA, 24 bp, Homo sapiens
tgggacacttgaaaattatgcatg

SEQ ID NO: 24051 - DNA, 24 bp, Homo sapiens
ctgggacacttgaaaattatgcat

SEQ ID NO: 24052 - DNA, 24 bp, Homo sapiens
cctgggacacttgaaaattatgca

SEQ ID NO: 24053 - DNA, 24 bp, Homo sapiens
acttcaacaacggcacctacctgg

SEQ ID NO: 24054 - DNA, 24 bp, Homo sapiens
cacagcacagccaccatcctcaac

SEQ ID NO: 24055 - DNA, 24 bp, Homo sapiens
ggaggttgcggtgagccaggattg

SEQ ID NO: 24056 - DNA, 24 bp, Homo sapiens
cccattgaggtcataccatgcccg

SEQ ID NO: 24057 - DNA, 25 bp, Homo sapiens
tctcactctgtcaccaagactggag

SEQ ID NO: 24058 - DNA, 25 bp, Homo sapiens
taactccccattcgctcctgtcctt

SEQ ID NO: 24059 - DNA, 23 bp, Homo sapiens
tctgcctgtggtcccagctactc

SEQ ID NO: 24060 - DNA, 23 bp, Homo sapiens
cagagtgagccgaggttgtgcca

SEQ ID NO: 24061 - DNA, 23 bp, Homo sapiens
tttttaaaaattggccagtcacg

SEQ ID NO: 24062 - DNA, 24 bp, Homo sapiens
ttggcgttctgtgattccagcatc

SEQ ID NO: 24063 - DNA, 25 bp, Homo sapiens
ctctcctgtgtagatacattcggca

SEQ ID NO: 24064 - DNA, 23 bp, Homo sapiens
agtcagcagcaggcaggcagaag

SEQ ID NO: 24065 - DNA, 24 bp, Homo sapiens
ttattttctagaagaatcaaaaga

SEQ ID NO: 24066 - DNA, 24 bp, Homo sapiens
tttattttctagaagaatcaaaag

SEQ ID NO: 24067 - DNA, 24 bp, Homo sapiens
ttttattttctagaagaatcaaaa

SEQ ID NO: 24068 - DNA, 25 bp, Homo sapiens
tcactaacacttgcctagacagaga

SEQ ID NO: 24069 - DNA, 25 bp, Homo sapiens
gagcagaagcacttgaagcaacaca

SEQ ID NO: 24070 - DNA, 25 bp, Homo sapiens
acattagagaagaattacgacggct

SEQ ID NO: 24071 - DNA, 23 bp, Homo sapiens
cagcctgggtggacagaacaagg

SEQ ID NO: 24072 - DNA, 25 bp, Homo sapiens
aggtaagtattgcttccgccactgc

SEQ ID NO: 24073 - DNA, 25 bp, Homo sapiens
gccagtgctttggtaaaggtcctag

SEQ ID NO: 24074 - DNA, 24 bp, Homo sapiens
aaaaatctcagttaatttcagaaa

SEQ ID NO: 24075 - DNA, 24 bp, Homo sapiens
aaaaaatctcagttaatttcagaa

SEQ ID NO: 24076 - DNA, 24 bp, Homo sapiens
taaaaaatctcagttaatttcaga

SEQ ID NO: 24077 - DNA, 24 bp, Homo sapiens
aggatcaacagtttctaaacctct

SEQ ID NO: 24078 - DNA, 24 bp, Homo sapiens
aaggatcaacagtttctaaacctc

SEQ ID NO: 24079 - DNA, 24 bp, Homo sapiens
aaaggatcaacagtttctaaacct

SEQ ID NO: 24080 - DNA, 24 bp, Homo sapiens
acgttgatttggagccagcacttt

SEQ ID NO: 24081 - DNA, 24 bp, Homo sapiens
gacgttgatttggagccagcactt

SEQ ID NO: 24082 - DNA, 24 bp, Homo sapiens
ggacgttgatttggagccagcact

SEQ ID NO: 24083 - DNA, 24 bp, Homo sapiens
ttctttcatgggtaagtttattaa

SEQ ID NO: 24084 - DNA, 24 bp, Homo sapiens
attctttcatgggtaagtttatta

SEQ ID NO: 24085 - DNA, 24 bp, Homo sapiens
aattctttcatgggtaagtttatt

SEQ ID NO: 24086 - DNA, 24 bp, Homo sapiens
cacagactttggtaatattaacgg

SEQ ID NO: 24087 - DNA, 24 bp, Homo sapiens
acacagactttggtaatattaacg

SEQ ID NO: 24088 - DNA, 24 bp, Homo sapiens
cacacagactttggtaatattaac

SEQ ID NO: 24089 - DNA, 25 bp, Homo sapiens
tgtgcttgtgtattctgtcacctct

SEQ ID NO: 24090 - DNA, 24 bp, Homo sapiens
ggacacagcagggcaggatgagta

SEQ ID NO: 24091 - DNA, 25 bp, Homo sapiens
cggaaggctacgatcctacagtgga

SEQ ID NO: 24092 - DNA, 24 bp, Homo sapiens
tccgctacaggaaggtggtcatcc

SEQ ID NO: 24093 - DNA, 23 bp, Homo sapiens
ctctgagcccgcagttccgcaag

SEQ ID NO: 24094 - DNA, 23 bp, Homo sapiens
cctgctcacaccctgacctcgtt

SEQ ID NO: 24095 - DNA, 24 bp, Homo sapiens
ttattttaaaggttaaacagctac

SEQ ID NO: 24096 - DNA, 24 bp, Homo sapiens
tttattttaaaggttaaacagcta

SEQ ID NO: 24097 - DNA, 24 bp, Homo sapiens
ctttattttaaaggttaaacagct

SEQ ID NO: 24098 - DNA, 24 bp, Homo sapiens
cctggcttcaagtgatcctcctgc

SEQ ID NO: 24099 - DNA, 24 bp, Homo sapiens
ggaacaagactggtaacctgccta

SEQ ID NO: 24100 - DNA, 24 bp, Homo sapiens
gcacgaacctcatagctcctggac

SEQ ID NO: 24101 - DNA, 25 bp, Homo sapiens
cctcgtctccacaagtctgtctcct

SEQ ID NO: 24102 - DNA, 23 bp, Homo sapiens
ttgtggggtgtgctgcctccgaa

SEQ ID NO: 24103 - DNA, 23 bp, Homo sapiens
cgggccggggtcgcgcacctccc

SEQ ID NO: 24104 - DNA, 24 bp, Homo sapiens
gcttttataagtgcctccaaagcc

SEQ ID NO: 24105 - DNA, 24 bp, Homo sapiens
agcttttataagtgcctccaaagc

SEQ ID NO: 24106 - DNA, 24 bp, Homo sapiens
cagcttttataagtgcctccaaag

SEQ ID NO: 24107 - DNA, 24 bp, Homo sapiens
tccttgttcaggttcaaagcactc

SEQ ID NO: 24108 - DNA, 24 bp, Homo sapiens
gtccttgttcaggttcaaagcact

SEQ ID NO: 24109 - DNA, 24 bp, Homo sapiens
tgtccttgttcaggttcaaagcac

SEQ ID NO: 24110 - DNA, 23 bp, Homo sapiens
ggaacccctgcccacccccggag

SEQ ID NO: 24111 - DNA, 23 bp, Homo sapiens
aaattgcggaacgcgaggggcga

SEQ ID NO: 24112 - DNA, 23 bp, Homo sapiens
gagcgagcaagcaagcaagcacc

SEQ ID NO: 24113 - DNA, 23 bp, Homo sapiens
ccttcagctacggcccgagcgag

SEQ ID NO: 24114 - DNA, 23 bp, Homo sapiens
ccgccgccatgttgggtttggag

SEQ ID NO: 24115 - DNA, 24 bp, Homo sapiens
atgtcttacaggtttctgcctaga

SEQ ID NO: 24116 - DNA, 24 bp, Homo sapiens
catgtcttacaggtttctgcctag

SEQ ID NO: 24117 - DNA, 24 bp, Homo sapiens
ccatgtcttacaggtttctgccta

SEQ ID NO: 24118 - DNA, 24 bp, Homo sapiens
ttgtttttcctgtctatggttaat

SEQ ID NO: 24119 - DNA, 24 bp, Homo sapiens
cttgtttttcctgtctatggttaa

SEQ ID NO: 24120 - DNA, 24 bp, Homo sapiens
ccttgtttttcctgtctatggtta

SEQ ID NO: 24121 - DNA, 23 bp, Homo sapiens
gcaggaaccaggtgtgccttcgc

SEQ ID NO: 24122 - DNA, 23 bp, Homo sapiens
agtcgtcgttcgccttctaccag

SEQ ID NO: 24123 - DNA, 23 bp, Homo sapiens
cgtgtggctgctggaggatatgc

SEQ ID NO: 24124 - DNA, 23 bp, Homo sapiens
tgctctgttggctaggctggagt

SEQ ID NO: 24125 - DNA, 25 bp, Homo sapiens
gccattccatagtcagaatagcagc

SEQ ID NO: 24126 - DNA, 25 bp, Homo sapiens
caggtgaatccataaagcaagagca

SEQ ID NO: 24127 - DNA, 23 bp, Homo sapiens
agagcctgaaggactcctcactg

SEQ ID NO: 24128 - DNA, 23 bp, Homo sapiens
ggccacatcatggaagattgtga

SEQ ID NO: 24129 - DNA, 23 bp, Homo sapiens
gcttctgtctccagcattgcaaa

SEQ ID NO: 24130 - DNA, 25 bp, Homo sapiens
cgtggcttcatactactggtccctc

SEQ ID NO: 24131 - DNA, 23 bp, Homo sapiens
actcctgccagcttgtccttgtg

SEQ ID NO: 24132 - DNA, 23 bp, Homo sapiens
gctgggctccgtggctcttatct

SEQ ID NO: 24133 - DNA, 23 bp, Homo sapiens
acggtggtggtggatgggaaaga

SEQ ID NO: 24134 - DNA, 23 bp, Homo sapiens
agcggcatcatcaacaccaaggc

SEQ ID NO: 24135 - DNA, 24 bp, Homo sapiens
ggtcatccacttgccaggcttgtt

SEQ ID NO: 24136 - DNA, 24 bp, Homo sapiens
tggtctggaaggattactattaat

SEQ ID NO: 24137 - DNA, 24 bp, Homo sapiens
ttggtctggaaggattactattaa

SEQ ID NO: 24138 - DNA, 24 bp, Homo sapiens
cttggtctggaaggattactatta

SEQ ID NO: 24139 - DNA, 23 bp, Homo sapiens
atctcctgacctcgtgatccgcc

SEQ ID NO: 24140 - DNA, 24 bp, Homo sapiens
cctgttagaatggcttggatctcg

SEQ ID NO: 24141 - DNA, 23 bp, Homo sapiens
gcgggagaatgaccctgtcggta

SEQ ID NO: 24142 - DNA, 23 bp, Homo sapiens
cggtgctggtgctggtgctggtg

SEQ ID NO: 24143 - DNA, 23 bp, Homo sapiens
ctgacctgctggctggtgcgcgg

SEQ ID NO: 24144 - DNA, 23 bp, Homo sapiens
aggccctgatgcggccagacccg

SEQ ID NO: 24145 - DNA, 23 bp, Homo sapiens
gctgataccagagcactgatggc

SEQ ID NO: 24146 - DNA, 25 bp, Homo sapiens
gctgtactccctggtgttcactgtg

SEQ ID NO: 24147 - DNA, 23 bp, Homo sapiens
ggcaatgtggtggtggtgatgat

SEQ ID NO: 24148 - DNA, 23 bp, Homo sapiens
gcttcggtgatcctcctgccttg

SEQ ID NO: 24149 - DNA, 23 bp, Homo sapiens
ctggagcacagcggcacaacctc

SEQ ID NO: 24150 - DNA, 23 bp, Homo sapiens
tcaggagggcgtttcagacaggg

SEQ ID NO: 24151 - DNA, 24 bp, Homo sapiens
gggtgcagtggctgtggtgctccc

SEQ ID NO: 24152 - DNA, 24 bp, Homo sapiens
cgggtgcagtggctgtggtgctcc

SEQ ID NO: 24153 - DNA, 24 bp, Homo sapiens
tcgggtgcagtggctgtggtgctc

SEQ ID NO: 24154 - DNA, 23 bp, Homo sapiens
gaatagcacccagcaccagcagt

SEQ ID NO: 24155 - DNA, 25 bp, Homo sapiens
tcaacatcatcaactgtgagaagcc

SEQ ID NO: 24156 - DNA, 23 bp, Homo sapiens
caaagtgagcggtatgcaggcgg

SEQ ID NO: 24157 - DNA, 24 bp, Homo sapiens
gtttaattatgaaatcattatcgc

SEQ ID NO: 24158 - DNA, 24 bp, Homo sapiens
agtttaattatgaaatcattatcg

SEQ ID NO: 24159 - DNA, 24 bp, Homo sapiens
cagtttaattatgaaatcattatc

SEQ ID NO: 24160 - DNA, 24 bp, Homo sapiens
acttataaaagatgaaatttagaa

SEQ ID NO: 24161 - DNA, 24 bp, Homo sapiens
gacttataaaagatgaaatttaga

SEQ ID NO: 24162 - DNA, 24 bp, Homo sapiens
agacttataaaagatgaaatttag

SEQ ID NO: 24163 - DNA, 24 bp, Homo sapiens
acttataaaaggatcagtgcaaag

SEQ ID NO: 24164 - DNA, 24 bp, Homo sapiens
gacttataaaaggatcagtgcaaa

SEQ ID NO: 24165 - DNA, 24 bp, Homo sapiens
agacttataaaaggatcagtgcaa

SEQ ID NO: 24166 - DNA, 24 bp, Homo sapiens
gataatacaatgtaagacattttt

SEQ ID NO: 24167 - DNA, 24 bp, Homo sapiens
ggataatacaatgtaagacatttt

SEQ ID NO: 24168 - DNA, 24 bp, Homo sapiens
aggataatacaatgtaagacattt

SEQ ID NO: 24169 - DNA, 24 bp, Homo sapiens
cagcaggaaaagtaagcaaaaaat

SEQ ID NO: 24170 - DNA, 24 bp, Homo sapiens
acagcaggaaaagtaagcaaaaaa

SEQ ID NO: 24171 - DNA, 24 bp, Homo sapiens
cacagcaggaaaagtaagcaaaaa

SEQ ID NO: 24172 - DNA, 24 bp, Homo sapiens
caggatggcaccagcaggttcacc

SEQ ID NO: 24173 - DNA, 24 bp, Homo sapiens
ccttggcatcagcaccttctcaca

SEQ ID NO: 24174 - DNA, 24 bp, Homo sapiens
ggctctacctgtgctgtgtttggc

SEQ ID NO: 24175 - DNA, 24 bp, Homo sapiens
ggcaggcagtggagcacgcagatg

SEQ ID NO: 24176 - DNA, 24 bp, Homo sapiens
cggcaggcagtggagcacgcagat

SEQ ID NO: 24177 - DNA, 24 bp, Homo sapiens
ccggcaggcagtggagcacgcaga

SEQ ID NO: 24178 - DNA, 24 bp, Homo sapiens
tttttattctaaaggcttttcaac

SEQ ID NO: 24179 - DNA, 24 bp, Homo sapiens
atttttattctaaaggcttttcaa

SEQ ID NO: 24180 - DNA, 24 bp, Homo sapiens
tatttttattctaaaggcttttca

SEQ ID NO: 24181 - DNA, 25 bp, Homo sapiens
cagcacatggtcaggttcctcttgg

SEQ ID NO: 24182 - DNA, 25 bp, Homo sapiens
cgtgagggagccgatatgtggattt

SEQ ID NO: 24183 - DNA, 25 bp, Homo sapiens
ctgaatcacggagtcaaggtggacg

SEQ ID NO: 24184 - DNA, 23 bp, Homo sapiens
aagaagaatggtggtggctggac

SEQ ID NO: 24185 - DNA, 25 bp, Homo sapiens
cagcacatggtcaggttcctcttgg

SEQ ID NO: 24186 - DNA, 25 bp, Homo sapiens
gcatcgcctactttcttctccagca

SEQ ID NO: 24187 - DNA, 23 bp, Homo sapiens
gcagcagctccagcaacctcaga

SEQ ID NO: 24188 - DNA, 25 bp, Homo sapiens
gctccttatctgtaggatgtgcagt

SEQ ID NO: 24189 - DNA, 23 bp, Homo sapiens
cctttcctgaggagcccagtggc

SEQ ID NO: 24190 - DNA, 24 bp, Homo sapiens
ctccttcccaggtgcagctattgc

SEQ ID NO: 24191 - DNA, 24 bp, Homo sapiens
gctccttcccaggtgcagctattg

SEQ ID NO: 24192 - DNA, 24 bp, Homo sapiens
tgctccttcccaggtgcagctatt

SEQ ID NO: 24193 - DNA, 24 bp, Homo sapiens
gcccagtacctttggtttcacaga

SEQ ID NO: 24194 - DNA, 24 bp, Homo sapiens
gattggagctggagtgagccttcc

SEQ ID NO: 24195 - DNA, 24 bp, Homo sapiens
tcactgtctggaagtctgtcggca

SEQ ID NO: 24196 - DNA, 23 bp, Homo sapiens
aagcccagccaagcccagccaag

SEQ ID NO: 24197 - DNA, 23 bp, Homo sapiens
ccttcctccgtcccggccgttag

SEQ ID NO: 24198 - DNA, 24 bp, Homo sapiens
aggaggagcagctggcccaggatg

SEQ ID NO: 24199 - DNA, 24 bp, Homo sapiens
aaggaggagcagctggcccaggat

SEQ ID NO: 24200 - DNA, 24 bp, Homo sapiens
caaggaggagcagctggcccagga

SEQ ID NO: 24201 - DNA, 24 bp, Homo sapiens
gacagtgtgtggcagcagcagcag

SEQ ID NO: 24202 - DNA, 24 bp, Homo sapiens
gctgtaccttggatgaatgttttc

SEQ ID NO: 24203 - DNA, 24 bp, Homo sapiens
ctgttcgggagcctccaggaggag

SEQ ID NO: 24204 - DNA, 24 bp, Homo sapiens
attcacaagacgttgaaaaacatt

SEQ ID NO: 24205 - DNA, 24 bp, Homo sapiens
cattcacaagacgttgaaaaacat

SEQ ID NO: 24206 - DNA, 24 bp, Homo sapiens
ccattcacaagacgttgaaaaaca

SEQ ID NO: 24207 - DNA, 25 bp, Homo sapiens
cctacactatctgtggcactcttca

SEQ ID NO: 24208 - DNA, 25 bp, Homo sapiens
gggtgagagaggttaaagctgatgg

SEQ ID NO: 24209 - DNA, 23 bp, Homo sapiens
aggagatggaggttgcggtgagt

SEQ ID NO: 24210 - DNA, 23 bp, Homo sapiens
aggagatggaggttgcggtgagt

SEQ ID NO: 24211 - DNA, 25 bp, Homo sapiens
catccagcctgagcaacagagtgag

SEQ ID NO: 24212 - DNA, 25 bp, Homo sapiens
ttgctgtggatactgtaaagggtgt

SEQ ID NO: 24213 - DNA, 24 bp, Homo sapiens
ggcgatggtgttgttggtaggagg

SEQ ID NO: 24214 - DNA, 24 bp, Homo sapiens
ggttctacaacagtcgcagcctgg

SEQ ID NO: 24215 - DNA, 23 bp, Homo sapiens
ccaccatccacttctcgtgtgcc

SEQ ID NO: 24216 - DNA, 25 bp, Homo sapiens
caccaccatcatcaccaccaccatc

SEQ ID NO: 24217 - DNA, 25 bp, Homo sapiens
gcttcaggagatgatgaggagacca

SEQ ID NO: 24218 - DNA, 23 bp, Homo sapiens
gttgcagaggttgtgtcccaggg

SEQ ID NO: 24219 - DNA, 25 bp, Homo sapiens
ctcgctgctcatcatgctcaagtca

SEQ ID NO: 24220 - DNA, 24 bp, Homo sapiens
aacctcctcttctcggcagtcctc

SEQ ID NO: 24221 - DNA, 23 bp, Homo sapiens
ccgctggtggatggcctgcacgg

SEQ ID NO: 24222 - DNA, 23 bp, Homo sapiens
gtcagcgtccacaaaggtcggag

SEQ ID NO: 24223 - DNA, 23 bp, Homo sapiens
ccgccttcacgaagctcggggag

SEQ ID NO: 24224 - DNA, 23 bp, Homo sapiens
tgtagcggcggcggcggcgtctc

SEQ ID NO: 24225 - DNA, 25 bp, Homo sapiens
atagagatgctgagggctgctgtga

SEQ ID NO: 24226 - DNA, 23 bp, Homo sapiens
gtcagcgtccacaaaggtcggag

SEQ ID NO: 24227 - DNA, 23 bp, Homo sapiens
cgactcttctcctgcggggcgaa

SEQ ID NO: 24228 - DNA, 23 bp, Homo sapiens
tgtgaggcagctccagaatcagg

SEQ ID NO: 24229 - DNA, 23 bp, Homo sapiens
ctgctgctggctgttggctgctc

SEQ ID NO: 24230 - DNA, 23 bp, Homo sapiens
gaggcaccaggactcttccagga

SEQ ID NO: 24231 - DNA, 24 bp, Homo sapiens
gaacactcatcctcattctggtcc

SEQ ID NO: 24232 - DNA, 24 bp, Homo sapiens
tgctgtccgtcttctacttcgcca

SEQ ID NO: 24233 - DNA, 24 bp, Homo sapiens
tacttctggctgctggtcctgtcc

SEQ ID NO: 24234 - DNA, 25 bp, Homo sapiens
tgatactatgatgagcaacacggaa

SEQ ID NO: 24235 - DNA, 25 bp, Homo sapiens
ttgcctgatgctattgaaaccctcg

SEQ ID NO: 24236 - DNA, 25 bp, Homo sapiens
aaaggagacggtgagtgtttctgac

SEQ ID NO: 24237 - DNA, 23 bp, Homo sapiens
ggtcccagtctaagtgccagcct

SEQ ID NO: 24238 - DNA, 23 bp, Homo sapiens
cctccactggcgactcagggctg

SEQ ID NO: 24239 - DNA, 23 bp, Homo sapiens
cttcccacccctccctcaaacca

SEQ ID NO: 24240 - DNA, 23 bp, Homo sapiens
agctgacccgtcacggtggagcc

SEQ ID NO: 24241 - DNA, 23 bp, Homo sapiens
cagcctctgccccgccgcgcccg

SEQ ID NO: 24242 - DNA, 24 bp, Homo sapiens
agttcgcattaagatggtggctgt

SEQ ID NO: 24243 - DNA, 24 bp, Homo sapiens
tggtgggcagagaagacagaaacg

SEQ ID NO: 24244 - DNA, 24 bp, Homo sapiens
gcactcaagcagagaagaaatcca

SEQ ID NO: 24245 - DNA, 24 bp, Homo sapiens
cccgctctttactcctcagtgtgg

SEQ ID NO: 24246 - DNA, 24 bp, Homo sapiens
ggcatcgtggagagtgttggagaa

SEQ ID NO: 24247 - DNA, 24 bp, Homo sapiens
tggtgggcagagaagacagaaacg

SEQ ID NO: 24248 - DNA, 23 bp, Homo sapiens
ctgtctgacgtgttccagcagtg

SEQ ID NO: 24249 - DNA, 23 bp, Homo sapiens
gttgccagccgagagagccagta

SEQ ID NO: 24250 - DNA, 23 bp, Homo sapiens
ttccacttccaccacggcggcct

SEQ ID NO: 24251 - DNA, 24 bp, Homo sapiens
ttaagatgaaggtcgcccccgata

SEQ ID NO: 24252 - DNA, 24 bp, Homo sapiens
tttaagatgaaggtcgcccccgat

SEQ ID NO: 24253 - DNA, 24 bp, Homo sapiens
ttttaagatgaaggtcgcccccga

SEQ ID NO: 24254 - DNA, 25 bp, Homo sapiens
gagcagaggaagccttgaggaccta

SEQ ID NO: 24255 - DNA, 25 bp, Homo sapiens
aggttccttggaagaagatgtctgc

SEQ ID NO: 24256 - DNA, 25 bp, Homo sapiens
tgatggatgtgtctggtgtgggttt

SEQ ID NO: 24257 - DNA, 25 bp, Homo sapiens
gagagtgcgtcctacagatgcttgc

SEQ ID NO: 24258 - DNA, 24 bp, Homo sapiens
ctgatgaagccactccgatgagcc

SEQ ID NO: 24259 - DNA, 25 bp, Homo sapiens
ctgctggcaccttgatcttggactt

SEQ ID NO: 24260 - DNA, 24 bp, Homo sapiens
aagtcaaagtaagtttaatttaat

SEQ ID NO: 24261 - DNA, 24 bp, Homo sapiens
taagtcaaagtaagtttaatttaa

SEQ ID NO: 24262 - DNA, 24 bp, Homo sapiens
ttaagtcaaagtaagtttaattta

SEQ ID NO: 24263 - DNA, 24 bp, Homo sapiens
tatctgttatcgtaagtacatata

SEQ ID NO: 24264 - DNA, 24 bp, Homo sapiens
atatctgttatcgtaagtacatat

SEQ ID NO: 24265 - DNA, 24 bp, Homo sapiens
aatatctgttatcgtaagtacata

SEQ ID NO: 24266 - DNA, 24 bp, Homo sapiens
acggtgaatggctacttcctggca

SEQ ID NO: 24267 - DNA, 25 bp, Homo sapiens
gctgggattacagtcctcttgtcgg

SEQ ID NO: 24268 - DNA, 23 bp, Homo sapiens
gagtctccctctgttgcccaggc

SEQ ID NO: 24269 - DNA, 24 bp, Homo sapiens
gatggagtctcgctcttcgcccag

SEQ ID NO: 24270 - DNA, 24 bp, Homo sapiens
ccctgtttgtttggatacaccagt

SEQ ID NO: 24271 - DNA, 24 bp, Homo sapiens
tttagtagagatgggatttcacca

SEQ ID NO: 24272 - DNA, 24 bp, Homo sapiens
taattttccaggtgtctgtgacct

SEQ ID NO: 24273 - DNA, 24 bp, Homo sapiens
ttaattttccaggtgtctgtgacc

SEQ ID NO: 24274 - DNA, 24 bp, Homo sapiens
tttaattttccaggtgtctgtgac

SEQ ID NO: 24275 - DNA, 24 bp, Homo sapiens
ccctacctcccagtgtctaagcca

SEQ ID NO: 24276 - DNA, 25 bp, Homo sapiens
ccttgtttcccttgctctggtctcc

SEQ ID NO: 24277 - DNA, 23 bp, Homo sapiens
ccctctgccaccaccgtttcttc

SEQ ID NO: 24278 - DNA, 25 bp, Homo sapiens
tcaagaataagtatcacgaaaacaa

SEQ ID NO: 24279 - DNA, 25 bp, Homo sapiens
gatatcaagaaagttcatgttattt

SEQ ID NO: 24280 - DNA, 24 bp, Homo sapiens
tttaagaccagatctttcttatga

SEQ ID NO: 24281 - DNA, 24 bp, Homo sapiens
ttttaagaccagatctttcttatg

SEQ ID NO: 24282 - DNA, 24 bp, Homo sapiens
attttaagaccagatctttcttat

SEQ ID NO: 24283 - DNA, 24 bp, Homo sapiens
cttcttttcaggctttaagagtaa

SEQ ID NO: 24284 - DNA, 24 bp, Homo sapiens
tcttcttttcaggctttaagagta

SEQ ID NO: 24285 - DNA, 24 bp, Homo sapiens
ttcttcttttcaggctttaagagt

SEQ ID NO: 24286 - DNA, 24 bp, Homo sapiens
aaaggcaccaagaagaaatttgaa

SEQ ID NO: 24287 - DNA, 24 bp, Homo sapiens
caaaggcaccaagaagaaatttga

SEQ ID NO: 24288 - DNA, 24 bp, Homo sapiens
acaaaggcaccaagaagaaatttg

SEQ ID NO: 24289 - DNA, 24 bp, Homo sapiens
tgttggagaaggagagctgcttgc

SEQ ID NO: 24290 - DNA, 24 bp, Homo sapiens
gctcctgcgatgtgaacttgagtc

SEQ ID NO: 24291 - DNA, 24 bp, Homo sapiens
agccaagaccattgtgatgattcc

SEQ ID NO: 24292 - DNA, 24 bp, Homo sapiens
cagccaggagccagcagacagagg

SEQ ID NO: 24293 - DNA, 24 bp, Homo sapiens
caacctgtactaccgctggctgac

SEQ ID NO: 24294 - DNA, 24 bp, Homo sapiens
cctgatgctgtggctggtcctgga

SEQ ID NO: 24295 - DNA, 24 bp, Homo sapiens
ccgtggctgggcaggagccgagga

SEQ ID NO: 24296 - DNA, 24 bp, Homo sapiens
gccgtggctgggcaggagccgagg

SEQ ID NO: 24297 - DNA, 24 bp, Homo sapiens
cgccgtggctgggcaggagccgag

SEQ ID NO: 24298 - DNA, 23 bp, Homo sapiens
tacctgcggctcaagtcctggtg

SEQ ID NO: 24299 - DNA, 24 bp, Homo sapiens
cccgaaatccgctgatggtgaaca

SEQ ID NO: 24300 - DNA, 23 bp, Homo sapiens
ctcctgtaccgccaccgcctgaa

SEQ ID NO: 24301 - DNA, 24 bp, Homo sapiens
attacatgatgactttgctgatgg

SEQ ID NO: 24302 - DNA, 24 bp, Homo sapiens
tattacatgatgactttgctgatg

SEQ ID NO: 24303 - DNA, 24 bp, Homo sapiens
ctattacatgatgactttgctgat

SEQ ID NO: 24304 - DNA, 23 bp, Homo sapiens
tcgctgctgctgctgacggacac

SEQ ID NO: 24305 - DNA, 23 bp, Homo sapiens
aggagtctgtgtgggatgaagcc

SEQ ID NO: 24306 - DNA, 23 bp, Homo sapiens
ctgccgcatgtgacctggtccag

SEQ ID NO: 24307 - DNA, 23 bp, Homo sapiens
gggtgtgctggctgtggtgtgtc

SEQ ID NO: 24308 - DNA, 23 bp, Homo sapiens
ctgcttgccttcgtgtccctgct

SEQ ID NO: 24309 - DNA, 24 bp, Homo sapiens
cctacggcaacactgtggtcatgg

SEQ ID NO: 24310 - DNA, 24 bp, Homo sapiens
cgcacagccaacatcaagagccta

SEQ ID NO: 24311 - DNA, 24 bp, Homo sapiens
gcgagtatccacaagcacagacca

SEQ ID NO: 24312 - DNA, 24 bp, Homo sapiens
tacagaccaagtttgctcgcctcc

SEQ ID NO: 24313 - DNA, 24 bp, Homo sapiens
gctggtctctaactcctgggctca

SEQ ID NO: 24314 - DNA, 24 bp, Homo sapiens
agaaacacagttcacagagatggg

SEQ ID NO: 24315 - DNA, 24 bp, Homo sapiens
aaacctggtatcactgggaggaca

SEQ ID NO: 24316 - DNA, 24 bp, Homo sapiens
gagccaccatgcctagccaatagt

SEQ ID NO: 24317 - DNA, 24 bp, Homo sapiens
actcctggtctcaagtgatcctcc

SEQ ID NO: 24318 - DNA, 24 bp, Homo sapiens
tgtccagtttatttgccaaattgg

SEQ ID NO: 24319 - DNA, 24 bp, Homo sapiens
gctcacgcctgtaatcgcaccatt

SEQ ID NO: 24320 - DNA, 24 bp, Homo sapiens
taacgttctcatatttggccgggt

SEQ ID NO: 24321 - DNA, 24 bp, Homo sapiens
cgatctcagctcactgcaacctcc

SEQ ID NO: 24322 - DNA, 24 bp, Homo sapiens
tgtgggaagaactttcgtagtggc

SEQ ID NO: 24323 - DNA, 24 bp, Homo sapiens
aggtttcatgtcattgagagaccc

SEQ ID NO: 24324 - DNA, 25 bp, Homo sapiens
cagtgtcggatggcgtttaatgggt

SEQ ID NO: 24325 - DNA, 24 bp, Homo sapiens
ttccaacatcctcgttacctctcc

SEQ ID NO: 24326 - DNA, 23 bp, Homo sapiens
aaccgacactgaggagaagccgt

SEQ ID NO: 24327 - DNA, 24 bp, Homo sapiens
aaagaagaagagtaagaatcatgc

SEQ ID NO: 24328 - DNA, 24 bp, Homo sapiens
gaaagaagaagagtaagaatcatg

SEQ ID NO: 24329 - DNA, 24 bp, Homo sapiens
agaaagaagaagagtaagaatcat

SEQ ID NO: 24330 - DNA, 23 bp, Homo sapiens
gtcgctcaacaagtgcctggtgc

SEQ ID NO: 24331 - DNA, 23 bp, Homo sapiens
gctggtggcgctgctgggctcgg

SEQ ID NO: 24332 - DNA, 23 bp, Homo sapiens
cctgtgtctctgtagcctcctgc

SEQ ID NO: 24333 - DNA, 23 bp, Homo sapiens
actgggcgatggtggctgtgacg

SEQ ID NO: 24334 - DNA, 23 bp, Homo sapiens
gcgttcgtgtacggctccatgag

SEQ ID NO: 24335 - DNA, 23 bp, Homo sapiens
atctcccacctcagcctcatccc

SEQ ID NO: 24336 - DNA, 24 bp, Homo sapiens
ccaacgaccatgagaaggtggagc

SEQ ID NO: 24337 - DNA, 24 bp, Homo sapiens
cactcaggtatgcgttcaccgtgg

SEQ ID NO: 24338 - DNA, 24 bp, Homo sapiens
tcacctacctgctgctctacctgc

SEQ ID NO: 24339 - DNA, 23 bp, Homo sapiens
acttcctcaacgacctgtgcgcg

SEQ ID NO: 24340 - DNA, 23 bp, Homo sapiens
ctgctgctgctgctgggccaggt

SEQ ID NO: 24341 - DNA, 23 bp, Homo sapiens
atctcccacctcagcctcatccc

SEQ ID NO: 24342 - DNA, 25 bp, Homo sapiens
gcccgttcatcgtgatcttccagtt

SEQ ID NO: 24343 - DNA, 24 bp, Homo sapiens
cgtcaccaacgaccatgagaaggt

SEQ ID NO: 24344 - DNA, 24 bp, Homo sapiens
aagacatcagcatcagcgaccagc

SEQ ID NO: 24345 - DNA, 24 bp, Homo sapiens
cgccgtgttctcactgctattcca

SEQ ID NO: 24346 - DNA, 23 bp, Homo sapiens
gaccaccaggctcatcgtgaacc

SEQ ID NO: 24347 - DNA, 23 bp, Homo sapiens
ccaccatcctcgtcacctcgctg

SEQ ID NO: 24348 - DNA, 23 bp, Homo sapiens
gcgttcgtgtacggctccatgag

SEQ ID NO: 24349 - DNA, 23 bp, Homo sapiens
actgggcgatggtggctgtgacg

SEQ ID NO: 24350 - DNA, 23 bp, Homo sapiens
agcagtcctcacacctcagcctc

SEQ ID NO: 24351 - DNA, 25 bp, Homo sapiens
aagaaagacgattccacctccctgc

SEQ ID NO: 24352 - DNA, 25 bp, Homo sapiens
acctgtccaagccctaatagagtca

SEQ ID NO: 24353 - DNA, 24 bp, Homo sapiens
tccagtttcagggtggcttctcca

SEQ ID NO: 24354 - DNA, 23 bp, Homo sapiens
cccagctcatccgtgtctcccag

SEQ ID NO: 24355 - DNA, 23 bp, Homo sapiens
gcccctcccagtgggtgacgctg

SEQ ID NO: 24356 - DNA, 25 bp, Homo sapiens
gtgctgatgaccacctgttctgtgt

SEQ ID NO: 24357 - DNA, 23 bp, Homo sapiens
tgggtggtctgtgcctctggaag

SEQ ID NO: 24358 - DNA, 25 bp, Homo sapiens
ccgaatgggaaccctgatgtgtgat

SEQ ID NO: 24359 - DNA, 23 bp, Homo sapiens
ctggacaaggttctggagcaggc

SEQ ID NO: 24360 - DNA, 23 bp, Homo sapiens
actccacgcacacagggtcagaa

SEQ ID NO: 24361 - DNA, 25 bp, Homo sapiens
gaaatggcaaagaacgaggtggacg

SEQ ID NO: 24362 - DNA, 24 bp, Homo sapiens
ctataacccaggaaagattaaata

SEQ ID NO: 24363 - DNA, 24 bp, Homo sapiens
cctataacccaggaaagattaaat

SEQ ID NO: 24364 - DNA, 24 bp, Homo sapiens
acctataacccaggaaagattaaa

SEQ ID NO: 24365 - DNA, 24 bp, Homo sapiens
gaagccttcgggtgcgcatcgcct

SEQ ID NO: 24366 - DNA, 24 bp, Homo sapiens
cgaagccttcgggtgcgcatcgcc

SEQ ID NO: 24367 - DNA, 24 bp, Homo sapiens
ccgaagccttcgggtgcgcatcgc

SEQ ID NO: 24368 - DNA, 24 bp, Homo sapiens
tctgcgaacagacctccggcctcg

SEQ ID NO: 24369 - DNA, 24 bp, Homo sapiens
ccgccgccgcccgcatcgaagctc

SEQ ID NO: 24370 - DNA, 24 bp, Homo sapiens
ccgcgccagccccgggagcctgcg

SEQ ID NO: 24371 - DNA, 24 bp, Homo sapiens
actggcctcagttggagaatattg

SEQ ID NO: 24372 - DNA, 24 bp, Homo sapiens
aactggcctcagttggagaatatt

SEQ ID NO: 24373 - DNA, 24 bp, Homo sapiens
gaactggcctcagttggagaatat

SEQ ID NO: 24374 - DNA, 24 bp, Homo sapiens
gagccagccaggcagggatgttag

SEQ ID NO: 24375 - DNA, 24 bp, Homo sapiens
ggagccagccaggcagggatgtta

SEQ ID NO: 24376 - DNA, 24 bp, Homo sapiens
aggagccagccaggcagggatgtt

SEQ ID NO: 24377 - DNA, 24 bp, Homo sapiens
gccttttttttttttttttttgag

SEQ ID NO: 24378 - DNA, 23 bp, Homo sapiens
ggcactcatccatagcgtccgtg

SEQ ID NO: 24379 - DNA, 23 bp, Homo sapiens
cggggctgctggtgacgagtatc

SEQ ID NO: 24380 - DNA, 24 bp, Homo sapiens
tcctgagggaatgcttccgagacc

SEQ ID NO: 24381 - DNA, 25 bp, Homo sapiens
ccagcaagccatgactcatccttcc

SEQ ID NO: 24382 - DNA, 24 bp, Homo sapiens
ccttgctccaggtgtactgctgac

SEQ ID NO: 24383 - DNA, 23 bp, Homo sapiens
ctcctcctgccttggctgactgg

SEQ ID NO: 24384 - DNA, 23 bp, Homo sapiens
cagactgcctggatatggtcgcc

SEQ ID NO: 24385 - DNA, 23 bp, Homo sapiens
cccagcacctcctcggcacacac

SEQ ID NO: 24386 - DNA, 25 bp, Homo sapiens
ttctggaacctggagtttgagagcc

SEQ ID NO: 24387 - DNA, 23 bp, Homo sapiens
ggaagccgcccagcacctcctcg

SEQ ID NO: 24388 - DNA, 23 bp, Homo sapiens
ggtctccgtttccccaggccaag

SEQ ID NO: 24389 - DNA, 23 bp, Homo sapiens
acgacttcagcgccttccagtcc

SEQ ID NO: 24390 - DNA, 25 bp, Homo sapiens
gctagagctttccattcatgcaccg

SEQ ID NO: 24391 - DNA, 23 bp, Homo sapiens
cagaccccaccgccctccctctc

SEQ ID NO: 24392 - DNA, 23 bp, Homo sapiens
gggtcgggccgcaggctcaggct

SEQ ID NO: 24393 - DNA, 24 bp, Homo sapiens
cttcttttcagtgaaaaagacatt

SEQ ID NO: 24394 - DNA, 24 bp, Homo sapiens
tcttcttttcagtgaaaaagacat

SEQ ID NO: 24395 - DNA, 24 bp, Homo sapiens
ttcttcttttcagtgaaaaagaca

SEQ ID NO: 24396 - DNA, 23 bp, Homo sapiens
ttagaggcataatccaccgcacc

SEQ ID NO: 24397 - DNA, 23 bp, Homo sapiens
aggctggtctcaaacttctgggt

SEQ ID NO: 24398 - DNA, 23 bp, Homo sapiens
atcatcccacttcagccccccaa

SEQ ID NO: 24399 - DNA, 24 bp, Homo sapiens
aaacaccagtggtaggcactaagg

SEQ ID NO: 24400 - DNA, 24 bp, Homo sapiens
caaacaccagtggtaggcactaag

SEQ ID NO: 24401 - DNA, 24 bp, Homo sapiens
gcaaacaccagtggtaggcactaa

SEQ ID NO: 24402 - DNA, 23 bp, Homo sapiens
aggcggcggcggctcccagtcac

SEQ ID NO: 24403 - DNA, 23 bp, Homo sapiens
ccggcgagcgcacgatgcactgc

SEQ ID NO: 24404 - DNA, 23 bp, Homo sapiens
cccagccccagccccagccccgg

SEQ ID NO: 24405 - DNA, 24 bp, Homo sapiens
ctccaccaccactgcctcaacgaa

SEQ ID NO: 24406 - DNA, 24 bp, Homo sapiens
gaggagtatgttgaggacaagagc

SEQ ID NO: 24407 - DNA, 24 bp, Homo sapiens
tggtcaatgtctgcatcaggagcc

SEQ ID NO: 24408 - DNA, 23 bp, Homo sapiens
cggctggaggtgacgtggcagac

SEQ ID NO: 24409 - DNA, 25 bp, Homo sapiens
gcctgaccctgagtcttttcctctc

SEQ ID NO: 24410 - DNA, 23 bp, Homo sapiens
aaatgtggtagcccggccagtgc

SEQ ID NO: 24411 - DNA, 25 bp, Homo sapiens
ccacctaccacgaagatctgtgacc

SEQ ID NO: 24412 - DNA, 24 bp, Homo sapiens
cttcttggtcagcgtccccatcac

SEQ ID NO: 24413 - DNA, 23 bp, Homo sapiens
cctggctgccgctgccgccactg

SEQ ID NO: 24414 - DNA, 23 bp, Homo sapiens
atctcctgacttcgtgatccgcc

SEQ ID NO: 24415 - DNA, 25 bp, Homo sapiens
aggcgtattgtggtataactgttgc

SEQ ID NO: 24416 - DNA, 25 bp, Homo sapiens
ccaggacgacagataagtcaacaca

SEQ ID NO: 24417 - DNA, 24 bp, Homo sapiens
tcctatttcagagtatgaagaaga

SEQ ID NO: 24418 - DNA, 24 bp, Homo sapiens
ttcctatttcagagtatgaagaag

SEQ ID NO: 24419 - DNA, 24 bp, Homo sapiens
tttcctatttcagagtatgaagaa

SEQ ID NO: 24420 - DNA, 24 bp, Homo sapiens
atcatttctgacaccaacaatgaa

SEQ ID NO: 24421 - DNA, 24 bp, Homo sapiens
tatcatttctgacaccaacaatga

SEQ ID NO: 24422 - DNA, 24 bp, Homo sapiens
ctatcatttctgacaccaacaatg

SEQ ID NO: 24423 - DNA, 23 bp, Homo sapiens
agtcctcgtccgcacttacctgg

SEQ ID NO: 24424 - DNA, 23 bp, Homo sapiens
tgaggcggcggacagaggagaag

SEQ ID NO: 24425 - DNA, 24 bp, Homo sapiens
ttcggcaatgactgggagaggact

SEQ ID NO: 24426 - DNA, 24 bp, Homo sapiens
acaaacttccgaacacgctgcaag

SEQ ID NO: 24427 - DNA, 24 bp, Homo sapiens
gacaaacttccgaacacgctgcaa

SEQ ID NO: 24428 - DNA, 24 bp, Homo sapiens
ggacaaacttccgaacacgctgca

SEQ ID NO: 24429 - DNA, 25 bp, Homo sapiens
agaacaacaagattagtgcggtgcc

SEQ ID NO: 24430 - DNA, 23 bp, Homo sapiens
cgactccacgcccaacctcaagg

SEQ ID NO: 24431 - DNA, 23 bp, Homo sapiens
ctccgtggtggacagtgccttcc

SEQ ID NO: 24432 - DNA, 23 bp, Homo sapiens
ctccgtggtggacagtgccttcc

SEQ ID NO: 24433 - DNA, 25 bp, Homo sapiens
gcaggtcttggacattgaaggcaac

SEQ ID NO: 24434 - DNA, 24 bp, Homo sapiens
aggaggaggaggaagaggaggagg

SEQ ID NO: 24435 - DNA, 24 bp, Homo sapiens
ggttatgtgtgtctattcagaata

SEQ ID NO: 24436 - DNA, 24 bp, Homo sapiens
tggttatgtgtgtctattcagaat

SEQ ID NO: 24437 - DNA, 24 bp, Homo sapiens
ttggttatgtgtgtctattcagaa

SEQ ID NO: 24438 - DNA, 24 bp, Homo sapiens
aaatatagcaggtaaacaaataga

SEQ ID NO: 24439 - DNA, 24 bp, Homo sapiens
aaaatatagcaggtaaacaaatag

SEQ ID NO: 24440 - DNA, 24 bp, Homo sapiens
gaaaatatagcaggtaaacaaata

SEQ ID NO: 24441 - DNA, 24 bp, Homo sapiens
gcaggagaacattcacgagtcacc

SEQ ID NO: 24442 - DNA, 25 bp, Homo sapiens
aagagcgacacagacaatgactggc

SEQ ID NO: 24443 - DNA, 23 bp, Homo sapiens
taagccaacctcctgcctcagcc

SEQ ID NO: 24444 - DNA, 25 bp, Homo sapiens
cggagtacagtggcatgatctcagc

SEQ ID NO: 24445 - DNA, 25 bp, Homo sapiens
cctcctgggttcaagacaatcctcc

SEQ ID NO: 24446 - DNA, 25 bp, Homo sapiens
tctcctctcatcagtctcacctcct

SEQ ID NO: 24447 - DNA, 24 bp, Homo sapiens
attatgctcagaaaactgccaatg

SEQ ID NO: 24448 - DNA, 24 bp, Homo sapiens
gattatgctcagaaaactgccaat

SEQ ID NO: 24449 - DNA, 24 bp, Homo sapiens
agattatgctcagaaaactgccaa

SEQ ID NO: 24450 - DNA, 24 bp, Homo sapiens
acatattttaggttttcaaacttg

SEQ ID NO: 24451 - DNA, 24 bp, Homo sapiens
tacatattttaggttttcaaactt

SEQ ID NO: 24452 - DNA, 24 bp, Homo sapiens
ttacatattttaggttttcaaact

SEQ ID NO: 24453 - DNA, 24 bp, Homo sapiens
actgttttcagctttctcattcca

SEQ ID NO: 24454 - DNA, 24 bp, Homo sapiens
aactgttttcagctttctcattcc

SEQ ID NO: 24455 - DNA, 24 bp, Homo sapiens
gaactgttttcagctttctcattc

SEQ ID NO: 24456 - DNA, 24 bp, Homo sapiens
ccctggaaagaatggagatgatgg

SEQ ID NO: 24457 - DNA, 24 bp, Homo sapiens
aacctggtcgtcctggtgagcgtg

SEQ ID NO: 24458 - DNA, 24 bp, Homo sapiens
gagatgctggtcctgctggtccta

SEQ ID NO: 24459 - DNA, 24 bp, Homo sapiens
aaggtgctgctggtcctgctggca

SEQ ID NO: 24460 - DNA, 24 bp, Homo sapiens
aaaggtgctgctggtcctgctggc

SEQ ID NO: 24461 - DNA, 24 bp, Homo sapiens
taaaggtgctgctggtcctgctgg

SEQ ID NO: 24462 - DNA, 24 bp, Homo sapiens
ccctctggtgaacctggcaaacaa

SEQ ID NO: 24463 - DNA, 24 bp, Homo sapiens
ctggtgctcctggtgctcctggtg

SEQ ID NO: 24464 - DNA, 24 bp, Homo sapiens
atcgtggtgagactggtcctgctg

SEQ ID NO: 24465 - DNA, 23 bp, Homo sapiens
gctgttctgaccaggcgtcctct

SEQ ID NO: 24466 - DNA, 23 bp, Homo sapiens
ggagaggctgctggatggtgacc

SEQ ID NO: 24467 - DNA, 25 bp, Homo sapiens
tctactgagtgaagccattacgtct

SEQ ID NO: 24468 - DNA, 25 bp, Homo sapiens
gacatgaccctgggagagtttgacc

SEQ ID NO: 24469 - DNA, 25 bp, Homo sapiens
gaagaagaagagcagagcagagcgg

SEQ ID NO: 24470 - DNA, 24 bp, Homo sapiens
gaagggaagaacagatttcattaa

SEQ ID NO: 24471 - DNA, 24 bp, Homo sapiens
accaggaaatggtccccagcgcag

SEQ ID NO: 24472 - DNA, 24 bp, Homo sapiens
caccaggaaatggtccccagcgca

SEQ ID NO: 24473 - DNA, 24 bp, Homo sapiens
gcaccaggaaatggtccccagcgc

SEQ ID NO: 24474 - DNA, 24 bp, Homo sapiens
agggtgctgctggccttcccggcg

SEQ ID NO: 24475 - DNA, 24 bp, Homo sapiens
aagggtgctgctggccttcccggc

SEQ ID NO: 24476 - DNA, 24 bp, Homo sapiens
caagggtgctgctggccttcccgg

SEQ ID NO: 24477 - DNA, 23 bp, Homo sapiens
gctgaactgcctgccctggacat

SEQ ID NO: 24478 - DNA, 24 bp, Homo sapiens
ccatcggaagacactgaaccctgc

SEQ ID NO: 24479 - DNA, 24 bp, Homo sapiens
gcctatgaacacagtggacctcgg

SEQ ID NO: 24480 - DNA, 24 bp, Homo sapiens
acatcaaggatgtaagtgcaaatt

SEQ ID NO: 24481 - DNA, 24 bp, Homo sapiens
gacatcaaggatgtaagtgcaaat

SEQ ID NO: 24482 - DNA, 24 bp, Homo sapiens
agacatcaaggatgtaagtgcaaa

SEQ ID NO: 24483 - DNA, 23 bp, Homo sapiens
ctggtgaaagaggacggactggc

SEQ ID NO: 24484 - DNA, 23 bp, Homo sapiens
gtcctgctggtggtcctggcttc

SEQ ID NO: 24485 - DNA, 23 bp, Homo sapiens
ccgtggtcctgaaggtgctcaag

SEQ ID NO: 24486 - DNA, 23 bp, Homo sapiens
acggcgagaagggagaagttgga

SEQ ID NO: 24487 - DNA, 23 bp, Homo sapiens
aggaagtgctggtgctcgtggcg

SEQ ID NO: 24488 - DNA, 24 bp, Homo sapiens
ggtcctactggagtgactggtcct

SEQ ID NO: 24489 - DNA, 24 bp, Homo sapiens
aactttaaaagtgttaaaaggaag

SEQ ID NO: 24490 - DNA, 24 bp, Homo sapiens
gaactttaaaagtgttaaaaggaa

SEQ ID NO: 24491 - DNA, 24 bp, Homo sapiens
agaactttaaaagtgttaaaagga

SEQ ID NO: 24492 - DNA, 25 bp, Homo sapiens
gtactcactatctgctctgaatcca

SEQ ID NO: 24493 - DNA, 25 bp, Homo sapiens
acaggagcgtataatggaacagtca

SEQ ID NO: 24494 - DNA, 25 bp, Homo sapiens
cagtgggcaggagatgaaggtgttg

SEQ ID NO: 24495 - DNA, 24 bp, Homo sapiens
ctggtgctgctggtactcctggtc

SEQ ID NO: 24496 - DNA, 24 bp, Homo sapiens
cctggtccacaaggattacaaggc

SEQ ID NO: 24497 - DNA, 24 bp, Homo sapiens
gtgaacgtggacctcctggattgg

SEQ ID NO: 24498 - DNA, 24 bp, Homo sapiens
cggaagtcaaggagaaagtggtcg

SEQ ID NO: 24499 - DNA, 24 bp, Homo sapiens
tccaggaggaccaggaagtgatgg

SEQ ID NO: 24500 - DNA, 24 bp, Homo sapiens
ggagaacctggcagagatggcgtc

SEQ ID NO: 24501 - DNA, 24 bp, Homo sapiens
tagatcagaatgtcaacaataaaa

SEQ ID NO: 24502 - DNA, 24 bp, Homo sapiens
ctagatcagaatgtcaacaataaa

SEQ ID NO: 24503 - DNA, 24 bp, Homo sapiens
tctagatcagaatgtcaacaataa

SEQ ID NO: 24504 - DNA, 24 bp, Homo sapiens
actggtcctattggtcctcctggc

SEQ ID NO: 24505 - DNA, 24 bp, Homo sapiens
ggtccaaagggtgacaagggtgaa

SEQ ID NO: 24506 - DNA, 24 bp, Homo sapiens
ctggtgctgctggtactcctggtc

SEQ ID NO: 24507 - DNA, 25 bp, Homo sapiens
cctaacctcaagtgatctgcctgcc

SEQ ID NO: 24508 - DNA, 24 bp, Homo sapiens
ggttcccaatccctctcagtcagc

SEQ ID NO: 24509 - DNA, 25 bp, Homo sapiens
tcttaatactgatctcctagcacac

SEQ ID NO: 24510 - DNA, 23 bp, Homo sapiens
gcacatccaggcttctcctcctc

SEQ ID NO: 24511 - DNA, 25 bp, Homo sapiens
ggctttatctctggctgttcgtccc

SEQ ID NO: 24512 - DNA, 23 bp, Homo sapiens
ccagaggcagagaggtgagggtg

SEQ ID NO: 24513 - DNA, 25 bp, Homo sapiens
cctccgtggttccgttgaagaagat

SEQ ID NO: 24514 - DNA, 23 bp, Homo sapiens
ccttcggaatggagtgctgctgg

SEQ ID NO: 24515 - DNA, 23 bp, Homo sapiens
tgagcagaggcggcagaatgttg

SEQ ID NO: 24516 - DNA, 24 bp, Homo sapiens
ctcctgacgccttcgacattgtgg

SEQ ID NO: 24517 - DNA, 25 bp, Homo sapiens
gaagttcatccatagagcctgccag

SEQ ID NO: 24518 - DNA, 24 bp, Homo sapiens
gtactcagacatggtggctgtggc

SEQ ID NO: 24519 - DNA, 23 bp, Homo sapiens
acaggcacaggcggaaggcagag

SEQ ID NO: 24520 - DNA, 25 bp, Homo sapiens
aagaccaccttctatgaggagcagg

SEQ ID NO: 24521 - DNA, 23 bp, Homo sapiens
cagtacatccgggcctgcctgga

SEQ ID NO: 24522 - DNA, 24 bp, Homo sapiens
ctctatttcagaaaacctgttaga

SEQ ID NO: 24523 - DNA, 24 bp, Homo sapiens
tctctatttcagaaaacctgttag

SEQ ID NO: 24524 - DNA, 24 bp, Homo sapiens
ttctctatttcagaaaacctgtta

SEQ ID NO: 24525 - DNA, 24 bp, Homo sapiens
taaaagctgagctgtattataatt

SEQ ID NO: 24526 - DNA, 24 bp, Homo sapiens
ctaaaagctgagctgtattataat

SEQ ID NO: 24527 - DNA, 24 bp, Homo sapiens
cctaaaagctgagctgtattataa

SEQ ID NO: 24528 - DNA, 24 bp, Homo sapiens
ctacagaaaatatcgaagggagag

SEQ ID NO: 24529 - DNA, 24 bp, Homo sapiens
gctacagaaaatatcgaagggaga

SEQ ID NO: 24530 - DNA, 24 bp, Homo sapiens
agctacagaaaatatcgaagggag

SEQ ID NO: 24531 - DNA, 24 bp, Homo sapiens
ccaggactgcatggattcccagga

SEQ ID NO: 24532 - DNA, 24 bp, Homo sapiens
attcagaggaagccaagggatgcc

SEQ ID NO: 24533 - DNA, 24 bp, Homo sapiens
ggagatgctggtgtgcctggacag

SEQ ID NO: 24534 - DNA, 24 bp, Homo sapiens
ccagaagattgccgtccaaccagg

SEQ ID NO: 24535 - DNA, 24 bp, Homo sapiens
gaggtggtgtgtctgctgttcccg

SEQ ID NO: 24536 - DNA, 24 bp, Homo sapiens
gaagcacagccagacggaccagga

SEQ ID NO: 24537 - DNA, 24 bp, Homo sapiens
cttctggaagggccaatgcgttcg

SEQ ID NO: 24538 - DNA, 24 bp, Homo sapiens
gcccagagagcccagcaaggccgg

SEQ ID NO: 24539 - DNA, 24 bp, Homo sapiens
gatccaggccgaggaccgaaaggg

SEQ ID NO: 24540 - DNA, 23 bp, Homo sapiens
ctggtgtcaggtgctggctgtgc

SEQ ID NO: 24541 - DNA, 23 bp, Homo sapiens
caggctgtctgcatgaggaggtg

SEQ ID NO: 24542 - DNA, 23 bp, Homo sapiens
cccagctatgtggaggccctaca

SEQ ID NO: 24543 - DNA, 24 bp, Homo sapiens
tgctgtgtacctcctccacgacaa

SEQ ID NO: 24544 - DNA, 23 bp, Homo sapiens
gcccgaggagtggtcttcccaag

SEQ ID NO: 24545 - DNA, 23 bp, Homo sapiens
agccgctggtgcagtggtccgtc

SEQ ID NO: 24546 - DNA, 24 bp, Homo sapiens
atgctgaatctgctggtgccttga

SEQ ID NO: 24547 - DNA, 24 bp, Homo sapiens
gtacgctgcttcaagtccgatcct

SEQ ID NO: 24548 - DNA, 24 bp, Homo sapiens
tgtgaaggaactggaagaaggagg

SEQ ID NO: 24549 - DNA, 24 bp, Homo sapiens
cagccagcaagggttgtgtctgta

SEQ ID NO: 24550 - DNA, 24 bp, Homo sapiens
gcagccagcaagggttgtgtctgt

SEQ ID NO: 24551 - DNA, 24 bp, Homo sapiens
cgcagccagcaagggttgtgtctg

SEQ ID NO: 24552 - DNA, 24 bp, Homo sapiens
cgggattctttggctttccaggag

SEQ ID NO: 24553 - DNA, 23 bp, Homo sapiens
cgggtgctgctggtttgaaagga

SEQ ID NO: 24554 - DNA, 24 bp, Homo sapiens
acggacttgtcggtgtaccaggat

SEQ ID NO: 24555 - DNA, 24 bp, Homo sapiens
tatataagcagttcacaagtgcag

SEQ ID NO: 24556 - DNA, 24 bp, Homo sapiens
ttatataagcagttcacaagtgca

SEQ ID NO: 24557 - DNA, 24 bp, Homo sapiens
cttatataagcagttcacaagtgc

SEQ ID NO: 24558 - DNA, 24 bp, Homo sapiens
aaggagaaaagggtataaaaggaa

SEQ ID NO: 24559 - DNA, 24 bp, Homo sapiens
aaaggagaaaagggtataaaagga

SEQ ID NO: 24560 - DNA, 24 bp, Homo sapiens
taaaggagaaaagggtataaaagg

SEQ ID NO: 24561 - DNA, 24 bp, Homo sapiens
cgcctccagcccgcctccaacttg

SEQ ID NO: 24562 - DNA, 24 bp, Homo sapiens
gccctgcccagattaagcgggagg

SEQ ID NO: 24563 - DNA, 24 bp, Homo sapiens
ccagggtaaggggttaaggaggtg

SEQ ID NO: 24564 - DNA, 25 bp, Homo sapiens
ccacagggaacacttcaggtctatg

SEQ ID NO: 24565 - DNA, 23 bp, Homo sapiens
ttacacgccacagccagacaacg

SEQ ID NO: 24566 - DNA, 25 bp, Homo sapiens
cctggaacctcctctgttgcacatg

SEQ ID NO: 24567 - DNA, 23 bp, Homo sapiens
cctggacctcctggacttgacgg

SEQ ID NO: 24568 - DNA, 24 bp, Homo sapiens
agtgatgagatatgtgaaccaggc

SEQ ID NO: 24569 - DNA, 23 bp, Homo sapiens
aaggtgacacttgcttcaactgc

SEQ ID NO: 24570 - DNA, 24 bp, Homo sapiens
aaggagtcaagggggatgttggcc

SEQ ID NO: 24571 - DNA, 24 bp, Homo sapiens
aaaggagtcaagggggatgttggc

SEQ ID NO: 24572 - DNA, 24 bp, Homo sapiens
gaaaggagtcaagggggatgttgg

SEQ ID NO: 24573 - DNA, 24 bp, Homo sapiens
cctgaacatcacagccaccaaccg

SEQ ID NO: 24574 - DNA, 25 bp, Homo sapiens
ggctgtgaggtcatcctggtcaatg

SEQ ID NO: 24575 - DNA, 23 bp, Homo sapiens
tcaacaagttcctggacagcacc

SEQ ID NO: 24576 - DNA, 25 bp, Homo sapiens
tggagatgtgctacaagatggacct

SEQ ID NO: 24577 - DNA, 23 bp, Homo sapiens
tccctgtgtacctgctccttgcc

SEQ ID NO: 24578 - DNA, 23 bp, Homo sapiens
cggtggtggctgtggtgatggac

SEQ ID NO: 24579 - DNA, 24 bp, Homo sapiens
aagggacgaagggtgacccaggcc

SEQ ID NO: 24580 - DNA, 24 bp, Homo sapiens
gaagggacgaagggtgacccaggc

SEQ ID NO: 24581 - DNA, 24 bp, Homo sapiens
agaagggacgaagggtgacccagg

SEQ ID NO: 24582 - DNA, 24 bp, Homo sapiens
caggtgctcggggtttgacaggaa

SEQ ID NO: 24583 - DNA, 24 bp, Homo sapiens
ccaggtgctcggggtttgacagga

SEQ ID NO: 24584 - DNA, 24 bp, Homo sapiens
tccaggtgctcggggtttgacagg

SEQ ID NO: 24585 - DNA, 24 bp, Homo sapiens
gcaacaggagataaaggtccacct

SEQ ID NO: 24586 - DNA, 24 bp, Homo sapiens
ggctccaatggtcctgtaggggaa

SEQ ID NO: 24587 - DNA, 24 bp, Homo sapiens
ggacgggatggtgctgttggagaa

SEQ ID NO: 24588 - DNA, 25 bp, Homo sapiens
catccaacccagtgacgacaacgaa

SEQ ID NO: 24589 - DNA, 24 bp, Homo sapiens
aatcagccatctgtgaagccagcc

SEQ ID NO: 24590 - DNA, 23 bp, Homo sapiens
ccaccaagccagccaccactaag

SEQ ID NO: 24591 - DNA, 23 bp, Homo sapiens
tgtcagcctgtcagcgttctcca

SEQ ID NO: 24592 - DNA, 23 bp, Homo sapiens
aacaccaccaccaccctggctcc

SEQ ID NO: 24593 - DNA, 23 bp, Homo sapiens
cttccccatctacctcttgtcct

SEQ ID NO: 24594 - DNA, 23 bp, Homo sapiens
catctcaaggtagctggtccgcc

SEQ ID NO: 24595 - DNA, 23 bp, Homo sapiens
caacaccaccaccaccctggctc

SEQ ID NO: 24596 - DNA, 24 bp, Homo sapiens
gtcagcctgtcagcgttctccatc

SEQ ID NO: 24597 - DNA, 23 bp, Homo sapiens
tgtcagcctgtcagcgttctcca

SEQ ID NO: 24598 - DNA, 25 bp, Homo sapiens
tgtggcagaaacatctcaaggtagc

SEQ ID NO: 24599 - DNA, 23 bp, Homo sapiens
caacaccaccaccaccctggctc

SEQ ID NO: 24600 - DNA, 23 bp, Homo sapiens
tgtcagcctgtcagcgttctcca

SEQ ID NO: 24601 - DNA, 23 bp, Homo sapiens
caacaccaccaccaccctggctc

SEQ ID NO: 24602 - DNA, 23 bp, Homo sapiens
catctcaaggtagctggtccgcc

SEQ ID NO: 24603 - DNA, 24 bp, Homo sapiens
caggagaaaagggtgaccggggtc

SEQ ID NO: 24604 - DNA, 24 bp, Homo sapiens
gcaggagaaaagggtgaccggggt

SEQ ID NO: 24605 - DNA, 24 bp, Homo sapiens
agcaggagaaaagggtgaccgggg

SEQ ID NO: 24606 - DNA, 24 bp, Homo sapiens
ctggcccagtgggtggtcatggag

SEQ ID NO: 24607 - DNA, 24 bp, Homo sapiens
cctggcccagtgggtggtcatgga

SEQ ID NO: 24608 - DNA, 24 bp, Homo sapiens
ccctggcccagtgggtggtcatgg

SEQ ID NO: 24609 - DNA, 24 bp, Homo sapiens
gtggctgagctggatggactggag

SEQ ID NO: 24610 - DNA, 24 bp, Homo sapiens
cctgagcctgtgggtcgtgtgtcg

SEQ ID NO: 24611 - DNA, 24 bp, Homo sapiens
agatcctcaatgcttccagcgacg

SEQ ID NO: 24612 - DNA, 24 bp, Homo sapiens
aggtgaaggtggcattgctcctgg

SEQ ID NO: 24613 - DNA, 24 bp, Homo sapiens
aaaggtgactctgaggatggagct

SEQ ID NO: 24614 - DNA, 24 bp, Homo sapiens
gtgaggctggagagaagggcgaac

SEQ ID NO: 24615 - DNA, 24 bp, Homo sapiens
tgactggacctactggagctgtgg

SEQ ID NO: 24616 - DNA, 24 bp, Homo sapiens
ggtccacaggggtctccaggtttg

SEQ ID NO: 24617 - DNA, 24 bp, Homo sapiens
caggtcgagatggtgccagtggaa

SEQ ID NO: 24618 - DNA, 24 bp, Homo sapiens
cagcaatggtgaccaaggtcccaa

SEQ ID NO: 24619 - DNA, 23 bp, Homo sapiens
ggaccagcagcatcagcatcacc

SEQ ID NO: 24620 - DNA, 23 bp, Homo sapiens
tctctacctacctcactgccacc

SEQ ID NO: 24621 - DNA, 25 bp, Homo sapiens
agcctctagtaatccaagccctctc

SEQ ID NO: 24622 - DNA, 24 bp, Homo sapiens
agaaaaagaagatggaaaatatca

SEQ ID NO: 24623 - DNA, 24 bp, Homo sapiens
aagaaaaagaagatggaaaatatc

SEQ ID NO: 24624 - DNA, 24 bp, Homo sapiens
caagaaaaagaagatggaaaatat

SEQ ID NO: 24625 - DNA, 24 bp, Homo sapiens
aaatacagaaggtaccaaagataa

SEQ ID NO: 24626 - DNA, 24 bp, Homo sapiens
taaatacagaaggtaccaaagata

SEQ ID NO: 24627 - DNA, 24 bp, Homo sapiens
ttaaatacagaaggtaccaaagat

SEQ ID NO: 24628 - DNA, 23 bp, Homo sapiens
gtccacagccctcaagtacagcg

SEQ ID NO: 24629 - DNA, 23 bp, Homo sapiens
aggaggaggaggagtctgacggt

SEQ ID NO: 24630 - DNA, 25 bp, Homo sapiens
ggctttaggacctgttgacacggag

SEQ ID NO: 24631 - DNA, 24 bp, Homo sapiens
aacatgcacaagtaagtattcact

SEQ ID NO: 24632 - DNA, 24 bp, Homo sapiens
gaacatgcacaagtaagtattcac

SEQ ID NO: 24633 - DNA, 24 bp, Homo sapiens
agaacatgcacaagtaagtattca

SEQ ID NO: 24634 - DNA, 24 bp, Homo sapiens
cgcagcctccttgttctcctccag

SEQ ID NO: 24635 - DNA, 24 bp, Homo sapiens
gcagattagaggtccaccgggaga

SEQ ID NO: 24636 - DNA, 24 bp, Homo sapiens
gggaccgccgggagtgcctggatc

SEQ ID NO: 24637 - DNA, 24 bp, Homo sapiens
caggcatcaacggcaaggatggga

SEQ ID NO: 24638 - DNA, 24 bp, Homo sapiens
catgaagggcagtgcaggacaggc

SEQ ID NO: 24639 - DNA, 24 bp, Homo sapiens
gacagaagggtgaccaaggcgaga

SEQ ID NO: 24640 - DNA, 24 bp, Homo sapiens
catgaagggcagtgcaggacaggc

SEQ ID NO: 24641 - DNA, 24 bp, Homo sapiens
gacagaagggtgaccaaggcgaga

SEQ ID NO: 24642 - DNA, 24 bp, Homo sapiens
aggcgtcaaaggagacaagggctc

SEQ ID NO: 24643 - DNA, 24 bp, Homo sapiens
ccagtgatcagggcaatttaggaa

SEQ ID NO: 24644 - DNA, 24 bp, Homo sapiens
tccagtgatcagggcaatttagga

SEQ ID NO: 24645 - DNA, 24 bp, Homo sapiens
atccagtgatcagggcaatttagg

SEQ ID NO: 24646 - DNA, 24 bp, Homo sapiens
gctctcagcagccccagccgctcg

SEQ ID NO: 24647 - DNA, 24 bp, Homo sapiens
agctctcagcagccccagccgctc

SEQ ID NO: 24648 - DNA, 24 bp, Homo sapiens
aagctctcagcagccccagccgct

SEQ ID NO: 24649 - DNA, 24 bp, Homo sapiens
ttcagcaaatggccaaaaataagt

SEQ ID NO: 24650 - DNA, 24 bp, Homo sapiens
attcagcaaatggccaaaaataag

SEQ ID NO: 24651 - DNA, 24 bp, Homo sapiens
tattcagcaaatggccaaaaataa

SEQ ID NO: 24652 - DNA, 24 bp, Homo sapiens
ggtgtggatggtctgactggacga

SEQ ID NO: 24653 - DNA, 24 bp, Homo sapiens
cctggggaacggggaagtctggga

SEQ ID NO: 24654 - DNA, 24 bp, Homo sapiens
cttcagtgcccaagtatctgcccg

SEQ ID NO: 24655 - DNA, 24 bp, Homo sapiens
tacaaaatttggtaagtttggaat

SEQ ID NO: 24656 - DNA, 24 bp, Homo sapiens
atacaaaatttggtaagtttggaa

SEQ ID NO: 24657 - DNA, 24 bp, Homo sapiens
tatacaaaatttggtaagtttgga

SEQ ID NO: 24658 - DNA, 24 bp, Homo sapiens
atacaattcaaacagtcaaaaacc

SEQ ID NO: 24659 - DNA, 24 bp, Homo sapiens
tatacaattcaaacagtcaaaaac

SEQ ID NO: 24660 - DNA, 24 bp, Homo sapiens
gtatacaattcaaacagtcaaaaa

SEQ ID NO: 24661 - DNA, 24 bp, Homo sapiens
aatattttcatgtaagtatttcaa

SEQ ID NO: 24662 - DNA, 24 bp, Homo sapiens
caatattttcatgtaagtatttca

SEQ ID NO: 24663 - DNA, 24 bp, Homo sapiens
tcaatattttcatgtaagtatttc

SEQ ID NO: 24664 - DNA, 24 bp, Homo sapiens
acattttacagaaaaagaaatcca

SEQ ID NO: 24665 - DNA, 24 bp, Homo sapiens
cacattttacagaaaaagaaatcc

SEQ ID NO: 24666 - DNA, 24 bp, Homo sapiens
ccacattttacagaaaaagaaatc

SEQ ID NO: 24667 - DNA, 23 bp, Homo sapiens
aaaagaagatgaggacagtggct

SEQ ID NO: 24668 - DNA, 25 bp, Homo sapiens
gaagaaaagttatcaagcatcagca

SEQ ID NO: 24669 - DNA, 24 bp, Homo sapiens
tcaaaggaaaaatccaaaaagttt

SEQ ID NO: 24670 - DNA, 23 bp, Homo sapiens
tagggcaggtgggaagtcagcag

SEQ ID NO: 24671 - DNA, 25 bp, Homo sapiens
ggacatgagaccagtgtgaagactc

SEQ ID NO: 24672 - DNA, 25 bp, Homo sapiens
cccaaactgccctacctgactacct

SEQ ID NO: 24673 - DNA, 24 bp, Homo sapiens
aaagggagaagcctcagataacaa

SEQ ID NO: 24674 - DNA, 24 bp, Homo sapiens
gaaagggagaagcctcagataaca

SEQ ID NO: 24675 - DNA, 24 bp, Homo sapiens
agaaagggagaagcctcagataac

SEQ ID NO: 24676 - DNA, 24 bp, Homo sapiens
cccagagccagcccactgagtctc

SEQ ID NO: 24677 - DNA, 24 bp, Homo sapiens
ccccagagccagcccactgagtct

SEQ ID NO: 24678 - DNA, 24 bp, Homo sapiens
accccagagccagcccactgagtc

SEQ ID NO: 24679 - DNA, 24 bp, Homo sapiens
ccgacctgtccgcttcctgtatga

SEQ ID NO: 24680 - DNA, 23 bp, Homo sapiens
accgtgtggctgtggctgtgaag

SEQ ID NO: 24681 - DNA, 25 bp, Homo sapiens
cctcattgttgactgcaagaagcga

SEQ ID NO: 24682 - DNA, 23 bp, Homo sapiens
ccgaggtgccactgggaagtctg

SEQ ID NO: 24683 - DNA, 25 bp, Homo sapiens
gccaaagaggagaagtgggtttcca

SEQ ID NO: 24684 - DNA, 23 bp, Homo sapiens
tcagggagcagcaggagaaaccg

SEQ ID NO: 24685 - DNA, 25 bp, Homo sapiens
gccaaagaggagaagtgggtttcca

SEQ ID NO: 24686 - DNA, 23 bp, Homo sapiens
tcagggagcagcaggagaaaccg

SEQ ID NO: 24687 - DNA, 23 bp, Homo sapiens
ggatggtcctgctggtctgaggg

SEQ ID NO: 24688 - DNA, 23 bp, Homo sapiens
tcagggagcagcaggagaaaccg

SEQ ID NO: 24689 - DNA, 23 bp, Homo sapiens
ggatggtcctgctggtctgaggg

SEQ ID NO: 24690 - DNA, 23 bp, Homo sapiens
aggcactgctggtggacctggtt

SEQ ID NO: 24691 - DNA, 24 bp, Homo sapiens
ttttaccctaggaaagcagaattt

SEQ ID NO: 24692 - DNA, 24 bp, Homo sapiens
cttttaccctaggaaagcagaatt

SEQ ID NO: 24693 - DNA, 24 bp, Homo sapiens
tcttttaccctaggaaagcagaat

SEQ ID NO: 24694 - DNA, 24 bp, Homo sapiens
ctttctccaagaccatcttaaatg

SEQ ID NO: 24695 - DNA, 24 bp, Homo sapiens
tctttctccaagaccatcttaaat

SEQ ID NO: 24696 - DNA, 24 bp, Homo sapiens
ctctttctccaagaccatcttaaa

SEQ ID NO: 24697 - DNA, 24 bp, Homo sapiens
tatttatttagtaccacgcagtgg

SEQ ID NO: 24698 - DNA, 24 bp, Homo sapiens
ttatttatttagtaccacgcagtg

SEQ ID NO: 24699 - DNA, 24 bp, Homo sapiens
tttatttatttagtaccacgcagt

SEQ ID NO: 24700 - DNA, 24 bp, Homo sapiens
tgttacaggagacaatggaagaat

SEQ ID NO: 24701 - DNA, 24 bp, Homo sapiens
atgttacaggagacaatggaagaa

SEQ ID NO: 24702 - DNA, 24 bp, Homo sapiens
tatgttacaggagacaatggaaga

SEQ ID NO: 24703 - DNA, 24 bp, Homo sapiens
aaagaagaaaggtaatttttattt

SEQ ID NO: 24704 - DNA, 24 bp, Homo sapiens
caaagaagaaaggtaatttttatt

SEQ ID NO: 24705 - DNA, 24 bp, Homo sapiens
acaaagaagaaaggtaatttttat

SEQ ID NO: 24706 - DNA, 24 bp, Homo sapiens
ttttgctttaggctttaacagact

SEQ ID NO: 24707 - DNA, 24 bp, Homo sapiens
tttttgctttaggctttaacagac

SEQ ID NO: 24708 - DNA, 24 bp, Homo sapiens
ctttttgctttaggctttaacaga

SEQ ID NO: 24709 - DNA, 24 bp, Homo sapiens
agattttccaggtaatgctgttgc

SEQ ID NO: 24710 - DNA, 24 bp, Homo sapiens
cagattttccaggtaatgctgttg

SEQ ID NO: 24711 - DNA, 24 bp, Homo sapiens
gcagattttccaggtaatgctgtt

SEQ ID NO: 24712 - DNA, 23 bp, Homo sapiens
aagcaatcctcccacctcagcct

SEQ ID NO: 24713 - DNA, 23 bp, Homo sapiens
gcaaggactcggctatggcaaat

SEQ ID NO: 24714 - DNA, 24 bp, Homo sapiens
aagtctcactcttcacccaggctg

SEQ ID NO: 24715 - DNA, 24 bp, Homo sapiens
ggggacccaagggagaaaggggga

SEQ ID NO: 24716 - DNA, 24 bp, Homo sapiens
cggggacccaagggagaaaggggg

SEQ ID NO: 24717 - DNA, 24 bp, Homo sapiens
ccggggacccaagggagaaagggg

SEQ ID NO: 24718 - DNA, 24 bp, Homo sapiens
ggctctggctctggtgacctggtg

SEQ ID NO: 24719 - DNA, 24 bp, Homo sapiens
ggagaggatggacctgctggtgaa

SEQ ID NO: 24720 - DNA, 24 bp, Homo sapiens
ggacagcctggagttgatggagcc

SEQ ID NO: 24721 - DNA, 24 bp, Homo sapiens
aacccaaactctccagaccaacgg

SEQ ID NO: 24722 - DNA, 24 bp, Homo sapiens
ggatggatggagccagtattgtgg

SEQ ID NO: 24723 - DNA, 24 bp, Homo sapiens
tgacactggtttacctggctttcc

SEQ ID NO: 24724 - DNA, 24 bp, Homo sapiens
ggatggatggagccagtattgtgg

SEQ ID NO: 24725 - DNA, 24 bp, Homo sapiens
tctcggacattcctgagctggtgg

SEQ ID NO: 24726 - DNA, 24 bp, Homo sapiens
tgacactggtttacctggctttcc

SEQ ID NO: 24727 - DNA, 24 bp, Homo sapiens
caacgtgactggcttcaacctcat

SEQ ID NO: 24728 - DNA, 24 bp, Homo sapiens
ccaacgtgactggcttcaacctca

SEQ ID NO: 24729 - DNA, 24 bp, Homo sapiens
gccaacgtgactggcttcaacctc

SEQ ID NO: 24730 - DNA, 24 bp, Homo sapiens
aggacctaagggtgactgtggcaa

SEQ ID NO: 24731 - DNA, 24 bp, Homo sapiens
ctgaaaggagaccgaggagccacc

SEQ ID NO: 24732 - DNA, 24 bp, Homo sapiens
aggcgaacctggtacggatggtgc

SEQ ID NO: 24733 - DNA, 24 bp, Homo sapiens
gacagaagggccaggcaggagaga

SEQ ID NO: 24734 - DNA, 24 bp, Homo sapiens
gagccggcatgcctggtggacctg

SEQ ID NO: 24735 - DNA, 24 bp, Homo sapiens
gtggttccatggggcctgttgggc

SEQ ID NO: 24736 - DNA, 24 bp, Homo sapiens
cagaagggccaggcaggagagaag

SEQ ID NO: 24737 - DNA, 24 bp, Homo sapiens
ccttcggggagccctggcttgcct

SEQ ID NO: 24738 - DNA, 24 bp, Homo sapiens
catggggcctgttgggccaccggg

SEQ ID NO: 24739 - DNA, 24 bp, Homo sapiens
cttcccgacagcttcggggtacgg

SEQ ID NO: 24740 - DNA, 24 bp, Homo sapiens
tcttcccgacagcttcggggtacg

SEQ ID NO: 24741 - DNA, 24 bp, Homo sapiens
ttcttcccgacagcttcggggtac

SEQ ID NO: 24742 - DNA, 24 bp, Homo sapiens
aggagacaaaggtgaccaagtcta

SEQ ID NO: 24743 - DNA, 24 bp, Homo sapiens
aaggagacaaaggtgaccaagtct

SEQ ID NO: 24744 - DNA, 24 bp, Homo sapiens
aaaggagacaaaggtgaccaagtc

SEQ ID NO: 24745 - DNA, 23 bp, Homo sapiens
gctcactcacctgcctccactct

SEQ ID NO: 24746 - DNA, 23 bp, Homo sapiens
gctccagtggcaactcttctccg

SEQ ID NO: 24747 - DNA, 25 bp, Homo sapiens
gcatcttcttcaaccagaggacgga

SEQ ID NO: 24748 - DNA, 23 bp, Homo sapiens
caccaccaccacttccacagcat

SEQ ID NO: 24749 - DNA, 23 bp, Homo sapiens
gagtcctgcggctgtgaacactg

SEQ ID NO: 24750 - DNA, 25 bp, Homo sapiens
gctaatggagacctgaagactgtgt

SEQ ID NO: 24751 - DNA, 24 bp, Homo sapiens
atgacactgaggtatgtgatcaag

SEQ ID NO: 24752 - DNA, 24 bp, Homo sapiens
gatgacactgaggtatgtgatcaa

SEQ ID NO: 24753 - DNA, 24 bp, Homo sapiens
agatgacactgaggtatgtgatca

SEQ ID NO: 24754 - DNA, 24 bp, Homo sapiens
tcatggagcagcagcctcgtctta

SEQ ID NO: 24755 - DNA, 24 bp, Homo sapiens
gtcatggagcagcagcctcgtctt

SEQ ID NO: 24756 - DNA, 24 bp, Homo sapiens
ggtcatggagcagcagcctcgtct

SEQ ID NO: 24757 - DNA, 25 bp, Homo sapiens
ctgtggaagaagaaggaattgttgc

SEQ ID NO: 24758 - DNA, 25 bp, Homo sapiens
accaagaagaggtagcaagactgga

SEQ ID NO: 24759 - DNA, 25 bp, Homo sapiens
gccagaagaagagaaaaggaagagg

SEQ ID NO: 24760 - DNA, 24 bp, Homo sapiens
agaaaaaaaaaggttaaatataga

SEQ ID NO: 24761 - DNA, 24 bp, Homo sapiens
aagaaaaaaaaaggttaaatatag

SEQ ID NO: 24762 - DNA, 24 bp, Homo sapiens
gaagaaaaaaaaaggttaaatata

SEQ ID NO: 24763 - DNA, 24 bp, Homo sapiens
aggataacaaggtatggcttcttt

SEQ ID NO: 24764 - DNA, 24 bp, Homo sapiens
aaggataacaaggtatggcttctt

SEQ ID NO: 24765 - DNA, 24 bp, Homo sapiens
caaggataacaaggtatggcttct

SEQ ID NO: 24766 - DNA, 24 bp, Homo sapiens
ataaaattaagggaggtgtgaatg

SEQ ID NO: 24767 - DNA, 24 bp, Homo sapiens
tataaaattaagggaggtgtgaat

SEQ ID NO: 24768 - DNA, 24 bp, Homo sapiens
atataaaattaagggaggtgtgaa

SEQ ID NO: 24769 - DNA, 24 bp, Homo sapiens
ttccaaacaagggtgaaaatggtt

SEQ ID NO: 24770 - DNA, 24 bp, Homo sapiens
attccaaacaagggtgaaaatggt

SEQ ID NO: 24771 - DNA, 24 bp, Homo sapiens
cattccaaacaagggtgaaaatgg

SEQ ID NO: 24772 - DNA, 24 bp, Homo sapiens
ccttggattccatgtgaatgtgcc

SEQ ID NO: 24773 - DNA, 24 bp, Homo sapiens
tgtttcactcctgtttgattctga

SEQ ID NO: 24774 - DNA, 24 bp, Homo sapiens
atgacagattcacttccccattca

SEQ ID NO: 24775 - DNA, 24 bp, Homo sapiens
ggcacacccagaatgaagaagatg

SEQ ID NO: 24776 - DNA, 24 bp, Homo sapiens
tggcacacccagaatgaagaagat

SEQ ID NO: 24777 - DNA, 24 bp, Homo sapiens
ttggcacacccagaatgaagaaga

SEQ ID NO: 24778 - DNA, 24 bp, Homo sapiens
ggcaatgacgacctgtccacaact

SEQ ID NO: 24779 - DNA, 24 bp, Homo sapiens
gcatccactatgtcacaacctggt

SEQ ID NO: 24780 - DNA, 25 bp, Homo sapiens
ttgatttaatcgctgccctgccttt

SEQ ID NO: 24781 - DNA, 23 bp, Homo sapiens
atcaagccctgcccagccaacta

SEQ ID NO: 24782 - DNA, 25 bp, Homo sapiens
gccctactatgtgctttgaagaccg

SEQ ID NO: 24783 - DNA, 24 bp, Homo sapiens
gcctaaacatcgccctggtgaatg

SEQ ID NO: 24784 - DNA, 25 bp, Homo sapiens
ccctcatctttgccatagtcacgac

SEQ ID NO: 24785 - DNA, 23 bp, Homo sapiens
atcaagccctgcccagccaacta

SEQ ID NO: 24786 - DNA, 25 bp, Homo sapiens
gccctactatgtgctttgaagaccg

SEQ ID NO: 24787 - DNA, 23 bp, Homo sapiens
gtggtgctgctgctgcttctgag

SEQ ID NO: 24788 - DNA, 23 bp, Homo sapiens
cggctggaacgagttcatcctgc

SEQ ID NO: 24789 - DNA, 24 bp, Homo sapiens
ccacaacctgctcatgggtgacac

SEQ ID NO: 24790 - DNA, 23 bp, Homo sapiens
gtggtgctgctgctgcttctgag

SEQ ID NO: 24791 - DNA, 23 bp, Homo sapiens
cggctggaacgagttcatcctgc

SEQ ID NO: 24792 - DNA, 23 bp, Homo sapiens
gccattgacacctactgcgagca

SEQ ID NO: 24793 - DNA, 25 bp, Homo sapiens
tgctcagaggtgctttgaagatgcc

SEQ ID NO: 24794 - DNA, 23 bp, Homo sapiens
gtggtgctgctgctgcttctgag

SEQ ID NO: 24795 - DNA, 23 bp, Homo sapiens
cggctggaacgagttcatcctgc

SEQ ID NO: 24796 - DNA, 25 bp, Homo sapiens
atggttgctgctgcttctaacaatt

SEQ ID NO: 24797 - DNA, 25 bp, Homo sapiens
gctacaactgtgatgccaacctcca

SEQ ID NO: 24798 - DNA, 23 bp, Homo sapiens
atctggcactgaatggaaggcat

SEQ ID NO: 24799 - DNA, 25 bp, Homo sapiens
ggtctgctcagttcaacggctacaa

SEQ ID NO: 24800 - DNA, 25 bp, Homo sapiens
atggttgctgctgcttctaacaatt

SEQ ID NO: 24801 - DNA, 25 bp, Homo sapiens
ggtctgctcagttcaacggctacaa

SEQ ID NO: 24802 - DNA, 25 bp, Homo sapiens
atggttgctgctgcttctaacaatt

SEQ ID NO: 24803 - DNA, 25 bp, Homo sapiens
tgctatggcaagatgatgctcaggt

SEQ ID NO: 24804 - DNA, 23 bp, Homo sapiens
gactcacctgctgccctggaatc

SEQ ID NO: 24805 - DNA, 24 bp, Homo sapiens
ttcctcctattcagacctcagcga

SEQ ID NO: 24806 - DNA, 23 bp, Homo sapiens
ggcgaggactccactgatgactc

SEQ ID NO: 24807 - DNA, 24 bp, Homo sapiens
gaagggaccggattttctggcatc

SEQ ID NO: 24808 - DNA, 24 bp, Homo sapiens
agaagggaccggattttctggcat

SEQ ID NO: 24809 - DNA, 24 bp, Homo sapiens
cagaagggaccggattttctggca

SEQ ID NO: 24810 - DNA, 24 bp, Homo sapiens
atgttgaagagttaatggaatttc

SEQ ID NO: 24811 - DNA, 24 bp, Homo sapiens
aatgttgaagagttaatggaattt

SEQ ID NO: 24812 - DNA, 24 bp, Homo sapiens
aaatgttgaagagttaatggaatt

SEQ ID NO: 24813 - DNA, 23 bp, Homo sapiens
gagagcaggagcggatgtggaga

SEQ ID NO: 24814 - DNA, 23 bp, Homo sapiens
tggcaggacagagttccgctacc

SEQ ID NO: 24815 - DNA, 23 bp, Homo sapiens
cctggcggtcacagacgaactgg

SEQ ID NO: 24816 - DNA, 24 bp, Homo sapiens
agtatagataggtaagaaaatgtt

SEQ ID NO: 24817 - DNA, 24 bp, Homo sapiens
gagtatagataggtaagaaaatgt

SEQ ID NO: 24818 - DNA, 24 bp, Homo sapiens
tgagtatagataggtaagaaaatg

SEQ ID NO: 24819 - DNA, 24 bp, Homo sapiens
cggaggagaggcagggaatcaagg

SEQ ID NO: 24820 - DNA, 24 bp, Homo sapiens
ctgttggctttcctggtcctcgtg

SEQ ID NO: 24821 - DNA, 24 bp, Homo sapiens
caggttatggtagtgtcggacgca

SEQ ID NO: 24822 - DNA, 24 bp, Homo sapiens
gctgtgtcctggtgtggcggtcag

SEQ ID NO: 24823 - DNA, 24 bp, Homo sapiens
tgctgtgtcctggtgtggcggtca

SEQ ID NO: 24824 - DNA, 24 bp, Homo sapiens
gtgctgtgtcctggtgtggcggtc

SEQ ID NO: 24825 - DNA, 24 bp, Homo sapiens
gactacagccagcacactcagatg

SEQ ID NO: 24826 - DNA, 23 bp, Homo sapiens
cctatggctcggacttctggaag

SEQ ID NO: 24827 - DNA, 23 bp, Homo sapiens
ctgcaagaggacactgtgaggcg

SEQ ID NO: 24828 - DNA, 23 bp, Homo sapiens
tcctggtgtggcggtcagatgtc

SEQ ID NO: 24829 - DNA, 23 bp, Homo sapiens
gcctggaagcacctcttgtgtcc

SEQ ID NO: 24830 - DNA, 23 bp, Homo sapiens
ggctcttgatcctggcactgctg

SEQ ID NO: 24831 - DNA, 24 bp, Homo sapiens
tggagtgtgaagagctgagcagtc

SEQ ID NO: 24832 - DNA, 25 bp, Homo sapiens
gccacactgtagagctgccttatga

SEQ ID NO: 24833 - DNA, 23 bp, Homo sapiens
ctgcaagaggacactgtgaggcg

SEQ ID NO: 24834 - DNA, 23 bp, Homo sapiens
atgccaccttcagtgctgcctgg

SEQ ID NO: 24835 - DNA, 25 bp, Homo sapiens
ccagtgtcactagacctcatcattc

SEQ ID NO: 24836 - DNA, 23 bp, Homo sapiens
tcctggtgtggcggtcagatgtc

SEQ ID NO: 24837 - DNA, 25 bp, Homo sapiens
ccaagcggttatctgtgacatctct

SEQ ID NO: 24838 - DNA, 25 bp, Homo sapiens
agaggcagagacagaggagataacc

SEQ ID NO: 24839 - DNA, 25 bp, Homo sapiens
tcagagaatgcgactatacaacttg

SEQ ID NO: 24840 - DNA, 24 bp, Homo sapiens
ttagaaataaggtaaattgttaaa

SEQ ID NO: 24841 - DNA, 24 bp, Homo sapiens
attagaaataaggtaaattgttaa

SEQ ID NO: 24842 - DNA, 24 bp, Homo sapiens
aattagaaataaggtaaattgtta

SEQ ID NO: 24843 - DNA, 24 bp, Homo sapiens
ttttttaataggaaaaaactcagg

SEQ ID NO: 24844 - DNA, 24 bp, Homo sapiens
cttttttaataggaaaaaactcag

SEQ ID NO: 24845 - DNA, 24 bp, Homo sapiens
acttttttaataggaaaaaactca

SEQ ID NO: 24846 - DNA, 25 bp, Homo sapiens
acctgcccatcattcttcctagaca

SEQ ID NO: 24847 - DNA, 24 bp, Homo sapiens
aatgcagcaccactggtatccatg

SEQ ID NO: 24848 - DNA, 24 bp, Homo sapiens
gaaggctggaacaacgggagatgg

SEQ ID NO: 24849 - DNA, 24 bp, Homo sapiens
aaacagtacaggtaaaagaaaaaa

SEQ ID NO: 24850 - DNA, 24 bp, Homo sapiens
aaaacagtacaggtaaaagaaaaa

SEQ ID NO: 24851 - DNA, 24 bp, Homo sapiens
aaaaacagtacaggtaaaagaaaa

SEQ ID NO: 24852 - DNA, 23 bp, Homo sapiens
cctcacagcagcagcccaagaag

SEQ ID NO: 24853 - DNA, 25 bp, Homo sapiens
ggcttcctttactgctgcttccctg

SEQ ID NO: 24854 - DNA, 25 bp, Homo sapiens
aaccattgccttgaactcattgagc

SEQ ID NO: 24855 - DNA, 24 bp, Homo sapiens
attatgtacaggtaaaggggactt

SEQ ID NO: 24856 - DNA, 24 bp, Homo sapiens
cattatgtacaggtaaaggggact

SEQ ID NO: 24857 - DNA, 24 bp, Homo sapiens
acattatgtacaggtaaaggggac

SEQ ID NO: 24858 - DNA, 24 bp, Homo sapiens
atactttaaagaccattcgtgaga

SEQ ID NO: 24859 - DNA, 24 bp, Homo sapiens
aatactttaaagaccattcgtgag

SEQ ID NO: 24860 - DNA, 24 bp, Homo sapiens
aaatactttaaagaccattcgtga

SEQ ID NO: 24861 - DNA, 24 bp, Homo sapiens
atttcacacagaaatttaaatctt

SEQ ID NO: 24862 - DNA, 24 bp, Homo sapiens
catttcacacagaaatttaaatct

SEQ ID NO: 24863 - DNA, 24 bp, Homo sapiens
ccatttcacacagaaatttaaatc

SEQ ID NO: 24864 - DNA, 24 bp, Homo sapiens
ctgttttgcaggcaacaccaacat

SEQ ID NO: 24865 - DNA, 24 bp, Homo sapiens
actgttttgcaggcaacaccaaca

SEQ ID NO: 24866 - DNA, 24 bp, Homo sapiens
gactgttttgcaggcaacaccaac

SEQ ID NO: 24867 - DNA, 24 bp, Homo sapiens
agtgatcctcccatctcagcctcc

SEQ ID NO: 24868 - DNA, 23 bp, Homo sapiens
aggctggaatgttgtgcacctcc

SEQ ID NO: 24869 - DNA, 24 bp, Homo sapiens
gcagtcattaccgtcatcctggga

SEQ ID NO: 24870 - DNA, 23 bp, Homo sapiens
ctcttccgcctcaaggacacgca

SEQ ID NO: 24871 - DNA, 23 bp, Homo sapiens
gctgctgtggatgctgtggtacg

SEQ ID NO: 24872 - DNA, 24 bp, Homo sapiens
tttctttgcagatatataacaaac

SEQ ID NO: 24873 - DNA, 24 bp, Homo sapiens
ttttctttgcagatatataacaaa

SEQ ID NO: 24874 - DNA, 24 bp, Homo sapiens
attttctttgcagatatataacaa

SEQ ID NO: 24875 - DNA, 24 bp, Homo sapiens
gattatgatgggtaaatgtagtct

SEQ ID NO: 24876 - DNA, 24 bp, Homo sapiens
agattatgatgggtaaatgtagtc

SEQ ID NO: 24877 - DNA, 24 bp, Homo sapiens
aagattatgatgggtaaatgtagt

SEQ ID NO: 24878 - DNA, 24 bp, Homo sapiens
atctagtgaaagtaagttaacaca

SEQ ID NO: 24879 - DNA, 24 bp, Homo sapiens
tatctagtgaaagtaagttaacac

SEQ ID NO: 24880 - DNA, 24 bp, Homo sapiens
ttatctagtgaaagtaagttaaca

SEQ ID NO: 24881 - DNA, 24 bp, Homo sapiens
ggaggaggaggaggaggacgatga

SEQ ID NO: 24882 - DNA, 23 bp, Homo sapiens
ttgaagacagcagcagcagcagc

SEQ ID NO: 24883 - DNA, 23 bp, Homo sapiens
atgactactgccaggtgctccga

SEQ ID NO: 24884 - DNA, 24 bp, Homo sapiens
aaatagctaaggtaataaatatgg

SEQ ID NO: 24885 - DNA, 24 bp, Homo sapiens
aaaatagctaaggtaataaatatg

SEQ ID NO: 24886 - DNA, 24 bp, Homo sapiens
taaaatagctaaggtaataaatat

SEQ ID NO: 24887 - DNA, 24 bp, Homo sapiens
tttctctttagctattggagatct

SEQ ID NO: 24888 - DNA, 24 bp, Homo sapiens
ttttctctttagctattggagatc

SEQ ID NO: 24889 - DNA, 24 bp, Homo sapiens
tttttctctttagctattggagat

SEQ ID NO: 24890 - DNA, 24 bp, Homo sapiens
ttgaatttagggtttaattgtgga

SEQ ID NO: 24891 - DNA, 24 bp, Homo sapiens
cttgaatttagggtttaattgtgg

SEQ ID NO: 24892 - DNA, 24 bp, Homo sapiens
tcttgaatttagggtttaattgtg

SEQ ID NO: 24893 - DNA, 24 bp, Homo sapiens
ttcaggaacaggtcttttgccaac

SEQ ID NO: 24894 - DNA, 24 bp, Homo sapiens
cttcaggaacaggtcttttgccaa

SEQ ID NO: 24895 - DNA, 24 bp, Homo sapiens
ccttcaggaacaggtcttttgcca

SEQ ID NO: 24896 - DNA, 24 bp, Homo sapiens
ttggatggcagaaaagaatctgaa

SEQ ID NO: 24897 - DNA, 24 bp, Homo sapiens
attggatggcagaaaagaatctga

SEQ ID NO: 24898 - DNA, 24 bp, Homo sapiens
cattggatggcagaaaagaatctg

SEQ ID NO: 24899 - DNA, 24 bp, Homo sapiens
ggacttggcagagtgtttagaatt

SEQ ID NO: 24900 - DNA, 24 bp, Homo sapiens
aggacttggcagagtgtttagaat

SEQ ID NO: 24901 - DNA, 24 bp, Homo sapiens
aaggacttggcagagtgtttagaa

SEQ ID NO: 24902 - DNA, 24 bp, Homo sapiens
tgtatttacaggaaatatgtattg

SEQ ID NO: 24903 - DNA, 24 bp, Homo sapiens
atgtatttacaggaaatatgtatt

SEQ ID NO: 24904 - DNA, 24 bp, Homo sapiens
tatgtatttacaggaaatatgtat

SEQ ID NO: 24905 - DNA, 24 bp, Homo sapiens
atccctctccggagaataagccaa

SEQ ID NO: 24906 - DNA, 24 bp, Homo sapiens
gatccctctccggagaataagcca

SEQ ID NO: 24907 - DNA, 24 bp, Homo sapiens
agatccctctccggagaataagcc

SEQ ID NO: 24908 - DNA, 24 bp, Homo sapiens
ctttgggcactgcctctgggaccc

SEQ ID NO: 24909 - DNA, 24 bp, Homo sapiens
cgcggcccggagctctgttccctg

SEQ ID NO: 24910 - DNA, 24 bp, Homo sapiens
gtccagagcccagcccagccctac

SEQ ID NO: 24911 - DNA, 24 bp, Homo sapiens
gtccagagcccagcccagccctac

SEQ ID NO: 24912 - DNA, 24 bp, Homo sapiens
ctcactggaaggaatccctggagc

SEQ ID NO: 24913 - DNA, 24 bp, Homo sapiens
agtgtcagaagtgtgaagggtgcc

SEQ ID NO: 24914 - DNA, 24 bp, Homo sapiens
aaaacagacagaattatgatgaca

SEQ ID NO: 24915 - DNA, 24 bp, Homo sapiens
gaaaacagacagaattatgatgac

SEQ ID NO: 24916 - DNA, 24 bp, Homo sapiens
tgaaaacagacagaattatgatga

SEQ ID NO: 24917 - DNA, 23 bp, Homo sapiens
cgcccagccagtgcccacagcag

SEQ ID NO: 24918 - DNA, 23 bp, Homo sapiens
cggtgggtagggtgcagggcggc

SEQ ID NO: 24919 - DNA, 23 bp, Homo sapiens
agccgaggccgcgtgcggaggcg

SEQ ID NO: 24920 - DNA, 24 bp, Homo sapiens
aaatgatgcagtatgtgccaagag

SEQ ID NO: 24921 - DNA, 24 bp, Homo sapiens
gaaatgatgcagtatgtgccaaga

SEQ ID NO: 24922 - DNA, 24 bp, Homo sapiens
agaaatgatgcagtatgtgccaag

SEQ ID NO: 24923 - DNA, 25 bp, Homo sapiens
tccacttaaagacaacccaaaccag

SEQ ID NO: 24924 - DNA, 25 bp, Homo sapiens
tcctcagtctgcggtagatacagcc

SEQ ID NO: 24925 - DNA, 24 bp, Homo sapiens
gctctcactctgttgcccatgctg

SEQ ID NO: 24926 - DNA, 24 bp, Homo sapiens
ctctataataggatatccagtttc

SEQ ID NO: 24927 - DNA, 24 bp, Homo sapiens
tctctataataggatatccagttt

SEQ ID NO: 24928 - DNA, 24 bp, Homo sapiens
ttctctataataggatatccagtt

SEQ ID NO: 24929 - DNA, 24 bp, Homo sapiens
atcaggtctcagggtccagtgtca

SEQ ID NO: 24930 - DNA, 24 bp, Homo sapiens
ggaggagtggcagcaactggacta

SEQ ID NO: 24931 - DNA, 24 bp, Homo sapiens
atagccacctggtctcaatgggat

SEQ ID NO: 24932 - DNA, 24 bp, Homo sapiens
atcaggtctcagggtccagtgtca

SEQ ID NO: 24933 - DNA, 24 bp, Homo sapiens
gtggctgtggatttcacccaggag

SEQ ID NO: 24934 - DNA, 24 bp, Homo sapiens
caactggactatgctcagaggacc

SEQ ID NO: 24935 - DNA, 24 bp, Homo sapiens
aaatccaaatggtcagttttctgt

SEQ ID NO: 24936 - DNA, 24 bp, Homo sapiens
aaaatccaaatggtcagttttctg

SEQ ID NO: 24937 - DNA, 24 bp, Homo sapiens
gaaaatccaaatggtcagttttct

SEQ ID NO: 24938 - DNA, 24 bp, Homo sapiens
ttcatttacaggtctgcattacat

SEQ ID NO: 24939 - DNA, 24 bp, Homo sapiens
tttcatttacaggtctgcattaca

SEQ ID NO: 24940 - DNA, 24 bp, Homo sapiens
atttcatttacaggtctgcattac

SEQ ID NO: 24941 - DNA, 24 bp, Homo sapiens
agaagaactatgtaagttgattta

SEQ ID NO: 24942 - DNA, 24 bp, Homo sapiens
gagaagaactatgtaagttgattt

SEQ ID NO: 24943 - DNA, 24 bp, Homo sapiens
agagaagaactatgtaagttgatt

SEQ ID NO: 24944 - DNA, 24 bp, Homo sapiens
actgtgacatggagcaggagccgc

SEQ ID NO: 24945 - DNA, 24 bp, Homo sapiens
ccaagctgctttcagcacagcgtg

SEQ ID NO: 24946 - DNA, 24 bp, Homo sapiens
cagaggggaagctctgcctgggcc

SEQ ID NO: 24947 - DNA, 24 bp, Homo sapiens
gaatatgaatgggtcttactcttt

SEQ ID NO: 24948 - DNA, 24 bp, Homo sapiens
agaatatgaatgggtcttactctt

SEQ ID NO: 24949 - DNA, 24 bp, Homo sapiens
aagaatatgaatgggtcttactct

SEQ ID NO: 24950 - DNA, 25 bp, Homo sapiens
tgtcactctcaaggtcctccagcat

SEQ ID NO: 24951 - DNA, 24 bp, Homo sapiens
tcccacctcagcctctcaagtagc

SEQ ID NO: 24952 - DNA, 25 bp, Homo sapiens
gcattgactacagccagcagaagag

SEQ ID NO: 24953 - DNA, 24 bp, Homo sapiens
tcccacctcagcctctcaagtagc

SEQ ID NO: 24954 - DNA, 25 bp, Homo sapiens
gcattgactacagccagcagaagag

SEQ ID NO: 24955 - DNA, 25 bp, Homo sapiens
ccaacctacgagtcttgcttgctaa

SEQ ID NO: 24956 - DNA, 24 bp, Homo sapiens
tatgaggcaaggttaccagagaga

SEQ ID NO: 24957 - DNA, 24 bp, Homo sapiens
ttatgaggcaaggttaccagagag

SEQ ID NO: 24958 - DNA, 24 bp, Homo sapiens
tttatgaggcaaggttaccagaga

SEQ ID NO: 24959 - DNA, 23 bp, Homo sapiens
aaatcagggaggaggtggcaagc

SEQ ID NO: 24960 - DNA, 23 bp, Homo sapiens
ctgaccgccgcccacctcctctg

SEQ ID NO: 24961 - DNA, 23 bp, Homo sapiens
aggcagacgccgtcgagatgcag

SEQ ID NO: 24962 - DNA, 25 bp, Homo sapiens
ttgttctcatctgtgtctggtggca

SEQ ID NO: 24963 - DNA, 23 bp, Homo sapiens
tgagtggcaggctggtctctggc

SEQ ID NO: 24964 - DNA, 25 bp, Homo sapiens
tctggtaaggactcaagagaggtga

SEQ ID NO: 24965 - DNA, 25 bp, Homo sapiens
tccactggtcttcttctagtctacc

SEQ ID NO: 24966 - DNA, 25 bp, Homo sapiens
ttgttctcatctgtgtctggtggca

SEQ ID NO: 24967 - DNA, 23 bp, Homo sapiens
tgagtggcaggctggtctctggc

SEQ ID NO: 24968 - DNA, 24 bp, Homo sapiens
gattaagaactgtaagcagcataa

SEQ ID NO: 24969 - DNA, 24 bp, Homo sapiens
agattaagaactgtaagcagcata

SEQ ID NO: 24970 - DNA, 24 bp, Homo sapiens
cagattaagaactgtaagcagcat

SEQ ID NO: 24971 - DNA, 24 bp, Homo sapiens
gaatttaaaatgtaagtattagag

SEQ ID NO: 24972 - DNA, 24 bp, Homo sapiens
agaatttaaaatgtaagtattaga

SEQ ID NO: 24973 - DNA, 24 bp, Homo sapiens
cagaatttaaaatgtaagtattag

SEQ ID NO: 24974 - DNA, 24 bp, Homo sapiens
tttttctatagacaccaaatctgg

SEQ ID NO: 24975 - DNA, 24 bp, Homo sapiens
ctttttctatagacaccaaatctg

SEQ ID NO: 24976 - DNA, 24 bp, Homo sapiens
tctttttctatagacaccaaatct

SEQ ID NO: 24977 - DNA, 24 bp, Homo sapiens
acaaaatgaagcatcttctgagac

SEQ ID NO: 24978 - DNA, 24 bp, Homo sapiens
tacaaaatgaagcatcttctgaga

SEQ ID NO: 24979 - DNA, 24 bp, Homo sapiens
ctacaaaatgaagcatcttctgag

SEQ ID NO: 24980 - DNA, 25 bp, Homo sapiens
ttcctgctcctcaagatcaacctct

SEQ ID NO: 24981 - DNA, 23 bp, Homo sapiens
cgggctgggctggctctgataca

SEQ ID NO: 24982 - DNA, 23 bp, Homo sapiens
gccttgctcttggtggtagtgac

SEQ ID NO: 24983 - DNA, 24 bp, Homo sapiens
atatcccaggcaggcacagctacg

SEQ ID NO: 24984 - DNA, 24 bp, Homo sapiens
gaatcccaagccatccagtctgcc

SEQ ID NO: 24985 - DNA, 24 bp, Homo sapiens
agcagacatcataaaggacttggc

SEQ ID NO: 24986 - DNA, 24 bp, Homo sapiens
atgcactatgaattgtggcttgga

SEQ ID NO: 24987 - DNA, 24 bp, Homo sapiens
aatgcactatgaattgtggcttgg

SEQ ID NO: 24988 - DNA, 24 bp, Homo sapiens
aaatgcactatgaattgtggcttg

SEQ ID NO: 24989 - DNA, 24 bp, Homo sapiens
aatgatatggtttggctgtgtccc

SEQ ID NO: 24990 - DNA, 24 bp, Homo sapiens
agagggctaccatcttccagttaa

SEQ ID NO: 24991 - DNA, 24 bp, Homo sapiens
aactagaagtccaattaaacctct

SEQ ID NO: 24992 - DNA, 23 bp, Homo sapiens
cagaatggctcggagacggtggt

SEQ ID NO: 24993 - DNA, 25 bp, Homo sapiens
cgccaacctcgtaagttacaggact

SEQ ID NO: 24994 - DNA, 23 bp, Homo sapiens
ggtgacggtgctggagtggagat

SEQ ID NO: 24995 - DNA, 24 bp, Homo sapiens
ttatatcccagcaaattaaatgaa

SEQ ID NO: 24996 - DNA, 24 bp, Homo sapiens
tttatatcccagcaaattaaatga

SEQ ID NO: 24997 - DNA, 24 bp, Homo sapiens
atttatatcccagcaaattaaatg

SEQ ID NO: 24998 - DNA, 25 bp, Homo sapiens
cagtgatgtgcgacaaggagttcat

SEQ ID NO: 24999 - DNA, 23 bp, Homo sapiens
ctgccaccgcctcctcatcttct

SEQ ID NO: 25000 - DNA, 25 bp, Homo sapiens
cctccttctcttcttctcctctccg

SEQ ID NO: 25001 - DNA, 25 bp, Homo sapiens
agccaacctgccctaccaaactatc

SEQ ID NO: 25002 - DNA, 25 bp, Homo sapiens
tcatcatccacacttctcagtcact

SEQ ID NO: 25003 - DNA, 25 bp, Homo sapiens
ttgaaatctgactacttgccctgcg

SEQ ID NO: 25004 - DNA, 24 bp, Homo sapiens
agcatcggaagggaaaattataac

SEQ ID NO: 25005 - DNA, 24 bp, Homo sapiens
cagcatcggaagggaaaattataa

SEQ ID NO: 25006 - DNA, 24 bp, Homo sapiens
acagcatcggaagggaaaattata

SEQ ID NO: 25007 - DNA, 24 bp, Homo sapiens
atataataaatgtaagtatgcaat

SEQ ID NO: 25008 - DNA, 24 bp, Homo sapiens
tatataataaatgtaagtatgcaa

SEQ ID NO: 25009 - DNA, 24 bp, Homo sapiens
ttatataataaatgtaagtatgca

SEQ ID NO: 25010 - DNA, 25 bp, Homo sapiens
ggagccaagagatgagacaagcctg

SEQ ID NO: 25011 - DNA, 25 bp, Homo sapiens
taggtgatagggtgtggctgtgtcc

SEQ ID NO: 25012 - DNA, 25 bp, Homo sapiens
atctcgtcttgaattgtagctccca

SEQ ID NO: 25013 - DNA, 23 bp, Homo sapiens
tagtggtggtggcagtcaacaac

SEQ ID NO: 25014 - DNA, 24 bp, Homo sapiens
cgtgtcatcacctccatcctctgc

SEQ ID NO: 25015 - DNA, 23 bp, Homo sapiens
gcccaggccctgtggctaaaccc

SEQ ID NO: 25016 - DNA, 23 bp, Homo sapiens
ctcaccagcctccagcagcagaa

SEQ ID NO: 25017 - DNA, 23 bp, Homo sapiens
cccgtggacccgaggaggatgag

SEQ ID NO: 25018 - DNA, 23 bp, Homo sapiens
cctctgtcgctggagaaccgccg

SEQ ID NO: 25019 - DNA, 25 bp, Homo sapiens
cacactgtaaggtgacacactcttt

SEQ ID NO: 25020 - DNA, 25 bp, Homo sapiens
tcacccacgaaaactatttgcatgt

SEQ ID NO: 25021 - DNA, 25 bp, Homo sapiens
aaatgcacagatgaagttttcagga

SEQ ID NO: 25022 - DNA, 23 bp, Homo sapiens
agcgtgccagtgcccaactcatt

SEQ ID NO: 25023 - DNA, 23 bp, Homo sapiens
gcgtacttgcttaggcaactgca

SEQ ID NO: 25024 - DNA, 23 bp, Homo sapiens
ccatggccgctgccgcccgagcc

SEQ ID NO: 25025 - DNA, 25 bp, Homo sapiens
agcacggaatgacaatctgacagcc

SEQ ID NO: 25026 - DNA, 25 bp, Homo sapiens
gctgggattactggcgtgaactacc

SEQ ID NO: 25027 - DNA, 23 bp, Homo sapiens
ggcggagagggcttggcactaaa

SEQ ID NO: 25028 - DNA, 24 bp, Homo sapiens
aaaaccccaaagtaagttattttt

SEQ ID NO: 25029 - DNA, 24 bp, Homo sapiens
taaaaccccaaagtaagttatttt

SEQ ID NO: 25030 - DNA, 24 bp, Homo sapiens
ataaaaccccaaagtaagttattt

SEQ ID NO: 25031 - DNA, 23 bp, Homo sapiens
atcatcaggcaggcacggctctc

SEQ ID NO: 25032 - DNA, 24 bp, Homo sapiens
caacatcgtggctaagaggagaag

SEQ ID NO: 25033 - DNA, 25 bp, Homo sapiens
gaacattgacaccagggctgaccat

SEQ ID NO: 25034 - DNA, 24 bp, Homo sapiens
actatttttaggttcacttgctcc

SEQ ID NO: 25035 - DNA, 24 bp, Homo sapiens
tactatttttaggttcacttgctc

SEQ ID NO: 25036 - DNA, 24 bp, Homo sapiens
gtactatttttaggttcacttgct

SEQ ID NO: 25037 - DNA, 24 bp, Homo sapiens
aaattgattcaggatttcttgtgg

SEQ ID NO: 25038 - DNA, 24 bp, Homo sapiens
taaattgattcaggatttcttgtg

SEQ ID NO: 25039 - DNA, 24 bp, Homo sapiens
ttaaattgattcaggatttcttgt

SEQ ID NO: 25040 - DNA, 24 bp, Homo sapiens
gttcttccgtgccaagtcgtgctt

SEQ ID NO: 25041 - DNA, 24 bp, Homo sapiens
ggctccaagtacggcatcatcacc

SEQ ID NO: 25042 - DNA, 24 bp, Homo sapiens
aggactggtggatggttggtgtca

SEQ ID NO: 25043 - DNA, 24 bp, Homo sapiens
aaaaatctctggtatgtatggaaa

SEQ ID NO: 25044 - DNA, 24 bp, Homo sapiens
caaaaatctctggtatgtatggaa

SEQ ID NO: 25045 - DNA, 24 bp, Homo sapiens
acaaaaatctctggtatgtatgga

SEQ ID NO: 25046 - DNA, 24 bp, Homo sapiens
gaagtttgtaggttggaatacaga

SEQ ID NO: 25047 - DNA, 24 bp, Homo sapiens
agaagtttgtaggttggaatacag

SEQ ID NO: 25048 - DNA, 24 bp, Homo sapiens
aagaagtttgtaggttggaataca

SEQ ID NO: 25049 - DNA, 24 bp, Homo sapiens
ggtcggagaaggctttgaggagga

SEQ ID NO: 25050 - DNA, 24 bp, Homo sapiens
ctacatcaagacatccaccaccgt

SEQ ID NO: 25051 - DNA, 24 bp, Homo sapiens
ccaccgccaccatgcccaacttcg

SEQ ID NO: 25052 - DNA, 24 bp, Homo sapiens
gctggtggcaggctctggggtcta

SEQ ID NO: 25053 - DNA, 24 bp, Homo sapiens
agctggtggcaggctctggggtct

SEQ ID NO: 25054 - DNA, 24 bp, Homo sapiens
gagctggtggcaggctctggggtc

SEQ ID NO: 25055 - DNA, 24 bp, Homo sapiens
aacctcagcatcatgatccaggac

SEQ ID NO: 25056 - DNA, 24 bp, Homo sapiens
gaacctcagcatcatgatccagga

SEQ ID NO: 25057 - DNA, 24 bp, Homo sapiens
agaacctcagcatcatgatccagg

SEQ ID NO: 25058 - DNA, 24 bp, Homo sapiens
ggcagtgccaggggccacaatgga

SEQ ID NO: 25059 - DNA, 24 bp, Homo sapiens
gggcagtgccaggggccacaatgg

SEQ ID NO: 25060 - DNA, 24 bp, Homo sapiens
ggggcagtgccaggggccacaatg

SEQ ID NO: 25061 - DNA, 24 bp, Homo sapiens
tgttgttcaaggtactcaaaaatt

SEQ ID NO: 25062 - DNA, 24 bp, Homo sapiens
ttgttgttcaaggtactcaaaaat

SEQ ID NO: 25063 - DNA, 24 bp, Homo sapiens
gttgttgttcaaggtactcaaaaa

SEQ ID NO: 25064 - DNA, 24 bp, Homo sapiens
tggctatcatactgctgataaaga

SEQ ID NO: 25065 - DNA, 24 bp, Homo sapiens
ctggctatcatactgctgataaag

SEQ ID NO: 25066 - DNA, 24 bp, Homo sapiens
tctggctatcatactgctgataaa

SEQ ID NO: 25067 - DNA, 24 bp, Homo sapiens
ttgccagaaaactttgtaaaatag

SEQ ID NO: 25068 - DNA, 24 bp, Homo sapiens
gttgccagaaaactttgtaaaata

SEQ ID NO: 25069 - DNA, 24 bp, Homo sapiens
ggttgccagaaaactttgtaaaat

SEQ ID NO: 25070 - DNA, 24 bp, Homo sapiens
tattattttagaacagccctcatg

SEQ ID NO: 25071 - DNA, 24 bp, Homo sapiens
ttattattttagaacagccctcat

SEQ ID NO: 25072 - DNA, 24 bp, Homo sapiens
tttattattttagaacagccctca

SEQ ID NO: 25073 - DNA, 25 bp, Homo sapiens
gtatcgtcagcctcctccttcaaca

SEQ ID NO: 25074 - DNA, 23 bp, Homo sapiens
gccagactgccgaggattatgct

SEQ ID NO: 25075 - DNA, 25 bp, Homo sapiens
cgtgctcctcaaacttggtgatctc

SEQ ID NO: 25076 - DNA, 24 bp, Homo sapiens
aatttcagaagcattcaacaacaa

SEQ ID NO: 25077 - DNA, 24 bp, Homo sapiens
caatttcagaagcattcaacaaca

SEQ ID NO: 25078 - DNA, 24 bp, Homo sapiens
acaatttcagaagcattcaacaac

SEQ ID NO: 25079 - DNA, 24 bp, Homo sapiens
caggaaatctggtgacactattct

SEQ ID NO: 25080 - DNA, 24 bp, Homo sapiens
ccaggaaatctggtgacactattc

SEQ ID NO: 25081 - DNA, 24 bp, Homo sapiens
tccaggaaatctggtgacactatt

SEQ ID NO: 25082 - DNA, 24 bp, Homo sapiens
aggagagacagaagtctcagccac

SEQ ID NO: 25083 - DNA, 24 bp, Homo sapiens
caggagagacagaagtctcagcca

SEQ ID NO: 25084 - DNA, 24 bp, Homo sapiens
ccaggagagacagaagtctcagcc

SEQ ID NO: 25085 - DNA, 24 bp, Homo sapiens
gaggaggaggcagccagaaccata

SEQ ID NO: 25086 - DNA, 24 bp, Homo sapiens
ctgagccgggggagggctccggga

SEQ ID NO: 25087 - DNA, 24 bp, Homo sapiens
cctggccaggccggcctgtctgcc

SEQ ID NO: 25088 - DNA, 24 bp, Homo sapiens
gcaggagtctggctgcgtcagaga

SEQ ID NO: 25089 - DNA, 24 bp, Homo sapiens
tgcaggagtctggctgcgtcagag

SEQ ID NO: 25090 - DNA, 24 bp, Homo sapiens
ctgcaggagtctggctgcgtcaga

SEQ ID NO: 25091 - DNA, 23 bp, Homo sapiens
gctgagaggaccaacagagttcc

SEQ ID NO: 25092 - DNA, 24 bp, Homo sapiens
cagagcaaggagactttgtcgggc

SEQ ID NO: 25093 - DNA, 24 bp, Homo sapiens
caggagtaggagcagatgaggcgt

SEQ ID NO: 25094 - DNA, 25 bp, Homo sapiens
aagatgtttctgtggctgtttctga

SEQ ID NO: 25095 - DNA, 24 bp, Homo sapiens
gcagattctgacatatcggtggaa

SEQ ID NO: 25096 - DNA, 25 bp, Homo sapiens
tgcgtgtcagttgagaatgtgctct

SEQ ID NO: 25097 - DNA, 24 bp, Homo sapiens
cattgccctgactgatatggaccc

SEQ ID NO: 25098 - DNA, 24 bp, Homo sapiens
aaggcagagatgctgacgactgtc

SEQ ID NO: 25099 - DNA, 23 bp, Homo sapiens
aaggtggctgagttggtgcagtt

SEQ ID NO: 25100 - DNA, 23 bp, Homo sapiens
aaggtggacaagttggtgcagtt

SEQ ID NO: 25101 - DNA, 25 bp, Homo sapiens
aaccgcctcctgattcttattctga

SEQ ID NO: 25102 - DNA, 25 bp, Homo sapiens
ctgtgcatctgaggaggtcatctgg

SEQ ID NO: 25103 - DNA, 25 bp, Homo sapiens
cgacgacagtgatgataacaatgat

SEQ ID NO: 25104 - DNA, 25 bp, Homo sapiens
agcagatgattccacttatgtcaca

SEQ ID NO: 25105 - DNA, 25 bp, Homo sapiens
tgatgacacagccacacaaccaaat

SEQ ID NO: 25106 - DNA, 25 bp, Homo sapiens
agcaattcttccacctcagccttcc

SEQ ID NO: 25107 - DNA, 25 bp, Homo sapiens
agtctagcatatcaccaccagcgga

SEQ ID NO: 25108 - DNA, 25 bp, Homo sapiens
tgtaacatctcttgagtcagcagca

SEQ ID NO: 25109 - DNA, 24 bp, Homo sapiens
attcatttcagatggagtgtgatg

SEQ ID NO: 25110 - DNA, 24 bp, Homo sapiens
aattcatttcagatggagtgtgat

SEQ ID NO: 25111 - DNA, 24 bp, Homo sapiens
aaattcatttcagatggagtgtga

SEQ ID NO: 25112 - DNA, 25 bp, Homo sapiens
tcagaagagattccagaaggagcag

SEQ ID NO: 25113 - DNA, 25 bp, Homo sapiens
tcaaagtcatccctgaaaccagcga

SEQ ID NO: 25114 - DNA, 25 bp, Homo sapiens
aagaggatgattctgactatggaca

SEQ ID NO: 25115 - DNA, 24 bp, Homo sapiens
ggtggaatgtaccagtgccaaagc

SEQ ID NO: 25116 - DNA, 25 bp, Homo sapiens
gctcatgcctgtaatcccaacactt

SEQ ID NO: 25117 - DNA, 23 bp, Homo sapiens
agcaggcggatcacttgaggtca

SEQ ID NO: 25118 - DNA, 24 bp, Homo sapiens
tctctttttactagtttctttcct

SEQ ID NO: 25119 - DNA, 24 bp, Homo sapiens
ttctctttttactagtttctttcc

SEQ ID NO: 25120 - DNA, 24 bp, Homo sapiens
tttctctttttactagtttctttc

SEQ ID NO: 25121 - DNA, 24 bp, Homo sapiens
tatatgtatagatacatatacata

SEQ ID NO: 25122 - DNA, 24 bp, Homo sapiens
atatatgtatagatacatatacat

SEQ ID NO: 25123 - DNA, 24 bp, Homo sapiens
catatatgtatagatacatataca

SEQ ID NO: 25124 - DNA, 24 bp, Homo sapiens
cggaaaattcggtaaaataatctt

SEQ ID NO: 25125 - DNA, 24 bp, Homo sapiens
acggaaaattcggtaaaataatct

SEQ ID NO: 25126 - DNA, 24 bp, Homo sapiens
tacggaaaattcggtaaaataatc

SEQ ID NO: 25127 - DNA, 24 bp, Homo sapiens
gcaatcctcccacctcagcctttc

SEQ ID NO: 25128 - DNA, 24 bp, Homo sapiens
actcagtatagcctagaactcctg

SEQ ID NO: 25129 - DNA, 24 bp, Homo sapiens
cccagactggagtgcagtggtgtg

SEQ ID NO: 25130 - DNA, 24 bp, Homo sapiens
tttcctaacagggtacaagtatga

SEQ ID NO: 25131 - DNA, 24 bp, Homo sapiens
atttcctaacagggtacaagtatg

SEQ ID NO: 25132 - DNA, 24 bp, Homo sapiens
tatttcctaacagggtacaagtat

SEQ ID NO: 25133 - DNA, 25 bp, Homo sapiens
acccagtgttatcatcctactcagt

SEQ ID NO: 25134 - DNA, 25 bp, Homo sapiens
ttgaagctgtaaaggttcttataga

SEQ ID NO: 25135 - DNA, 24 bp, Homo sapiens
ggatggtgcagattccatggagag

SEQ ID NO: 25136 - DNA, 24 bp, Homo sapiens
aggatggtgcagattccatggaga

SEQ ID NO: 25137 - DNA, 24 bp, Homo sapiens
gaggatggtgcagattccatggag

SEQ ID NO: 25138 - DNA, 24 bp, Homo sapiens
gcgggttcaagaaccaacaagcca

SEQ ID NO: 25139 - DNA, 24 bp, Homo sapiens
agcgggttcaagaaccaacaagcc

SEQ ID NO: 25140 - DNA, 24 bp, Homo sapiens
cagcgggttcaagaaccaacaagc

SEQ ID NO: 25141 - DNA, 24 bp, Homo sapiens
tttctgtgcaggaaatttatacaa

SEQ ID NO: 25142 - DNA, 24 bp, Homo sapiens
gtttctgtgcaggaaatttataca

SEQ ID NO: 25143 - DNA, 24 bp, Homo sapiens
tgtttctgtgcaggaaatttatac

SEQ ID NO: 25144 - DNA, 24 bp, Homo sapiens
agcctctcaaagccttcactgtgt

SEQ ID NO: 25145 - DNA, 24 bp, Homo sapiens
cctatgtatccctcaaagcaccgt

SEQ ID NO: 25146 - DNA, 24 bp, Homo sapiens
ccttgtatcactggcagcaggacg

SEQ ID NO: 25147 - DNA, 23 bp, Homo sapiens
ccgcatgatccagaggctgagat

SEQ ID NO: 25148 - DNA, 23 bp, Homo sapiens
cagcaggcagacatggggacgac

SEQ ID NO: 25149 - DNA, 23 bp, Homo sapiens
aacaccaagcaggagattgctga

SEQ ID NO: 25150 - DNA, 23 bp, Homo sapiens
gaggtgcctcagctcggaactcc

SEQ ID NO: 25151 - DNA, 24 bp, Homo sapiens
tcatccacctgctaaccgactatg

SEQ ID NO: 25152 - DNA, 23 bp, Homo sapiens
gcagcgtggagcaggcactcttg

SEQ ID NO: 25153 - DNA, 25 bp, Homo sapiens
atgtgaaccttgtgacaattaaccg

SEQ ID NO: 25154 - DNA, 25 bp, Homo sapiens
tggtggaatttcagattgctgggct

SEQ ID NO: 25155 - DNA, 25 bp, Homo sapiens
aagaagcggctaggatagcagaaga

SEQ ID NO: 25156 - DNA, 23 bp, Homo sapiens
cagtggcgcgatctcggctcatt

SEQ ID NO: 25157 - DNA, 25 bp, Homo sapiens
cgcctcccggaattcagataagatg

SEQ ID NO: 25158 - DNA, 23 bp, Homo sapiens
gcagtccttcatgctgcttgtca

SEQ ID NO: 25159 - DNA, 24 bp, Homo sapiens
ctatgccccgccccctccccagcc

SEQ ID NO: 25160 - DNA, 24 bp, Homo sapiens
cggaattaacccttcagggctggg

SEQ ID NO: 25161 - DNA, 24 bp, Homo sapiens
taaaaaataagggtcactcatcta

SEQ ID NO: 25162 - DNA, 24 bp, Homo sapiens
ttaaaaaataagggtcactcatct

SEQ ID NO: 25163 - DNA, 24 bp, Homo sapiens
gttaaaaaataagggtcactcatc

SEQ ID NO: 25164 - DNA, 24 bp, Homo sapiens
tgaggcagcaggccccgccagcag

SEQ ID NO: 25165 - DNA, 24 bp, Homo sapiens
ctgaggcagcaggccccgccagca

SEQ ID NO: 25166 - DNA, 24 bp, Homo sapiens
actgaggcagcaggccccgccagc

SEQ ID NO: 25167 - DNA, 25 bp, Homo sapiens
ccttccaatgtctgatgttcctgcc

SEQ ID NO: 25168 - DNA, 23 bp, Homo sapiens
atgagcaggagcagcagagcagc

SEQ ID NO: 25169 - DNA, 23 bp, Homo sapiens
actggaccttgataggcggcatc

SEQ ID NO: 25170 - DNA, 25 bp, Homo sapiens
gccctttactctcttctccctccag

SEQ ID NO: 25171 - DNA, 23 bp, Homo sapiens
ctccctcctcagcctcctgccca

SEQ ID NO: 25172 - DNA, 24 bp, Homo sapiens
ccttgctgaactggggtccctttg

SEQ ID NO: 25173 - DNA, 23 bp, Homo sapiens
actggaccttgataggcggcatc

SEQ ID NO: 25174 - DNA, 23 bp, Homo sapiens
atgagcaggagcagcagagcagc

SEQ ID NO: 25175 - DNA, 25 bp, Homo sapiens
gccctttactctcttctccctccag

SEQ ID NO: 25176 - DNA, 24 bp, Homo sapiens
tactgaagcagtaaaggaagaaca

SEQ ID NO: 25177 - DNA, 24 bp, Homo sapiens
ttactgaagcagtaaaggaagaac

SEQ ID NO: 25178 - DNA, 24 bp, Homo sapiens
gttactgaagcagtaaaggaagaa

SEQ ID NO: 25179 - DNA, 23 bp, Homo sapiens
cagccacagccgccactgcctac

SEQ ID NO: 25180 - DNA, 23 bp, Homo sapiens
ccgatgagcctcctgttgcctcc

SEQ ID NO: 25181 - DNA, 23 bp, Homo sapiens
actggaaccgtctgagcggccta

SEQ ID NO: 25182 - DNA, 24 bp, Homo sapiens
tttattcacagatataaaaccagc

SEQ ID NO: 25183 - DNA, 24 bp, Homo sapiens
atttattcacagatataaaaccag

SEQ ID NO: 25184 - DNA, 24 bp, Homo sapiens
catttattcacagatataaaacca

SEQ ID NO: 25185 - DNA, 24 bp, Homo sapiens
gtcttacaaaagtaggtaaaaaaa

SEQ ID NO: 25186 - DNA, 24 bp, Homo sapiens
tgtcttacaaaagtaggtaaaaaa

SEQ ID NO: 25187 - DNA, 24 bp, Homo sapiens
atgtcttacaaaagtaggtaaaaa

SEQ ID NO: 25188 - DNA, 24 bp, Homo sapiens
tactcttaaaggtaaatcaacaag

SEQ ID NO: 25189 - DNA, 24 bp, Homo sapiens
atactcttaaaggtaaatcaacaa

SEQ ID NO: 25190 - DNA, 24 bp, Homo sapiens
aatactcttaaaggtaaatcaaca

SEQ ID NO: 25191 - DNA, 24 bp, Homo sapiens
cattcctaaggagtttggtggtga

SEQ ID NO: 25192 - DNA, 24 bp, Homo sapiens
acattcctaaggagtttggtggtg

SEQ ID NO: 25193 - DNA, 24 bp, Homo sapiens
gacattcctaaggagtttggtggt

SEQ ID NO: 25194 - DNA, 24 bp, Homo sapiens
ggactccgcagccatcacccactc

SEQ ID NO: 25195 - DNA, 24 bp, Homo sapiens
tgtgtacgccaacggcggcctcaa

SEQ ID NO: 25196 - DNA, 24 bp, Homo sapiens
ttaccgcgggtacggggccttgag

SEQ ID NO: 25197 - DNA, 24 bp, Homo sapiens
gacctagacaagatcatagaactc

SEQ ID NO: 25198 - DNA, 24 bp, Homo sapiens
tgacctagacaagatcatagaact

SEQ ID NO: 25199 - DNA, 24 bp, Homo sapiens
atgacctagacaagatcatagaac

SEQ ID NO: 25200 - DNA, 24 bp, Homo sapiens
tcttgttataggatcatagaactc

SEQ ID NO: 25201 - DNA, 24 bp, Homo sapiens
ctcttgttataggatcatagaact

SEQ ID NO: 25202 - DNA, 24 bp, Homo sapiens
actcttgttataggatcatagaac

SEQ ID NO: 25203 - DNA, 23 bp, Homo sapiens
ccagagcgtcagcagcctgttcg

SEQ ID NO: 25204 - DNA, 23 bp, Homo sapiens
gagaagaacagctaccgccgcac

SEQ ID NO: 25205 - DNA, 23 bp, Homo sapiens
ctcctgctgctgctgctgctgct

SEQ ID NO: 25206 - DNA, 23 bp, Homo sapiens
gccgacatgaaggtgacgctgaa

SEQ ID NO: 25207 - DNA, 23 bp, Homo sapiens
gagcgtgaggagcagcagcacct

SEQ ID NO: 25208 - DNA, 23 bp, Homo sapiens
gtgagaagcagcaggtggagcag

SEQ ID NO: 25209 - DNA, 24 bp, Homo sapiens
atatgtctgagtttattgagagaa

SEQ ID NO: 25210 - DNA, 24 bp, Homo sapiens
aatatgtctgagtttattgagaga

SEQ ID NO: 25211 - DNA, 24 bp, Homo sapiens
aaatatgtctgagtttattgagag

SEQ ID NO: 25212 - DNA, 25 bp, Homo sapiens
caagttggagtacagtggcatgagt

SEQ ID NO: 25213 - DNA, 24 bp, Homo sapiens
agtctcaacctcctgggctcaagt

SEQ ID NO: 25214 - DNA, 23 bp, Homo sapiens
cccacctcagtctcctgagcagc

SEQ ID NO: 25215 - DNA, 24 bp, Homo sapiens
tttctctccagatcataacagtca

SEQ ID NO: 25216 - DNA, 24 bp, Homo sapiens
ctttctctccagatcataacagtc

SEQ ID NO: 25217 - DNA, 24 bp, Homo sapiens
tctttctctccagatcataacagt

SEQ ID NO: 25218 - DNA, 24 bp, Homo sapiens
acagggattgtattaccatatttg

SEQ ID NO: 25219 - DNA, 24 bp, Homo sapiens
cacagggattgtattaccatattt

SEQ ID NO: 25220 - DNA, 24 bp, Homo sapiens
tcacagggattgtattaccatatt

SEQ ID NO: 25221 - DNA, 24 bp, Homo sapiens
agatttgcaagatttaaaaagaaa

SEQ ID NO: 25222 - DNA, 24 bp, Homo sapiens
tagatttgcaagatttaaaaagaa

SEQ ID NO: 25223 - DNA, 24 bp, Homo sapiens
ttagatttgcaagatttaaaaaga

SEQ ID NO: 25224 - DNA, 24 bp, Homo sapiens
caaagtgaacacaggagaagaaat

SEQ ID NO: 25225 - DNA, 24 bp, Homo sapiens
gcaaagtgaacacaggagaagaaa

SEQ ID NO: 25226 - DNA, 24 bp, Homo sapiens
tgcaaagtgaacacaggagaagaa

SEQ ID NO: 25227 - DNA, 25 bp, Homo sapiens
atgctgttcacttacaccgtgttgg

SEQ ID NO: 25228 - DNA, 25 bp, Homo sapiens
cttgttagcatttacatcttcacca

SEQ ID NO: 25229 - DNA, 23 bp, Homo sapiens
tgcagccccagcccagcgtgcag

SEQ ID NO: 25230 - DNA, 24 bp, Homo sapiens
gaagtcaaacaatttaaaaagaaa

SEQ ID NO: 25231 - DNA, 24 bp, Homo sapiens
tgaagtcaaacaatttaaaaagaa

SEQ ID NO: 25232 - DNA, 24 bp, Homo sapiens
ctgaagtcaaacaatttaaaaaga

SEQ ID NO: 25233 - DNA, 24 bp, Homo sapiens
tgaagaagcagtgtgccgatctgg

SEQ ID NO: 25234 - DNA, 24 bp, Homo sapiens
gtgaagaagcagtgtgccgatctg

SEQ ID NO: 25235 - DNA, 24 bp, Homo sapiens
tgtgaagaagcagtgtgccgatct

SEQ ID NO: 25236 - DNA, 23 bp, Homo sapiens
ccaggagcgggagcagatcaagg

SEQ ID NO: 25237 - DNA, 24 bp, Homo sapiens
gtcaccgtcaacaagagcctcctg

SEQ ID NO: 25238 - DNA, 23 bp, Homo sapiens
ccaagtgtccctccgtgtgccca

SEQ ID NO: 25239 - DNA, 25 bp, Homo sapiens
ccgtctgtttctcccactgtccttg

SEQ ID NO: 25240 - DNA, 25 bp, Homo sapiens
aaattagctgggcatggtggcaaga

SEQ ID NO: 25241 - DNA, 23 bp, Homo sapiens
cttctgctccaaggaaccagctt

SEQ ID NO: 25242 - DNA, 24 bp, Homo sapiens
ttttaatttagaataaatcactcc

SEQ ID NO: 25243 - DNA, 24 bp, Homo sapiens
tttttaatttagaataaatcactc

SEQ ID NO: 25244 - DNA, 24 bp, Homo sapiens
atttttaatttagaataaatcact

SEQ ID NO: 25245 - DNA, 24 bp, Homo sapiens
cggccacccagagcccagcaaggc

SEQ ID NO: 25246 - DNA, 24 bp, Homo sapiens
acggccacccagagcccagcaagg

SEQ ID NO: 25247 - DNA, 24 bp, Homo sapiens
gacggccacccagagcccagcaag

SEQ ID NO: 25248 - DNA, 23 bp, Homo sapiens
caaggacgaggatggcagcagtg

SEQ ID NO: 25249 - DNA, 25 bp, Homo sapiens
tgaggaggtccaccatcgtctgtat

SEQ ID NO: 25250 - DNA, 25 bp, Homo sapiens
ggaccaggaagttcagaaggatgct

SEQ ID NO: 25251 - DNA, 23 bp, Homo sapiens
ctgctaagcgactgtgcgaacgt

SEQ ID NO: 25252 - DNA, 25 bp, Homo sapiens
ggacagcagttcattctggagaagg

SEQ ID NO: 25253 - DNA, 23 bp, Homo sapiens
cagcagcagccacaacagcaacc

SEQ ID NO: 25254 - DNA, 25 bp, Homo sapiens
ggacagcagttcattctggagaagg

SEQ ID NO: 25255 - DNA, 23 bp, Homo sapiens
cagcagcagccacaacagcaacc

SEQ ID NO: 25256 - DNA, 23 bp, Homo sapiens
gcgaaccacaatgacagccgtgt

SEQ ID NO: 25257 - DNA, 23 bp, Homo sapiens
cagcagcagccacaacagcaacc

SEQ ID NO: 25258 - DNA, 25 bp, Homo sapiens
ggacagcagttcattctggagaagg

SEQ ID NO: 25259 - DNA, 23 bp, Homo sapiens
gcgtttgggtggcctttgagtac

SEQ ID NO: 25260 - DNA, 24 bp, Homo sapiens
aaggaaaacaggtattggatattc

SEQ ID NO: 25261 - DNA, 24 bp, Homo sapiens
caaggaaaacaggtattggatatt

SEQ ID NO: 25262 - DNA, 24 bp, Homo sapiens
acaaggaaaacaggtattggatat

SEQ ID NO: 25263 - DNA, 24 bp, Homo sapiens
aagcgcccgtgacaggctacatgt

SEQ ID NO: 25264 - DNA, 24 bp, Homo sapiens
gaagcgcccgtgacaggctacatg

SEQ ID NO: 25265 - DNA, 24 bp, Homo sapiens
tgaagcgcccgtgacaggctacat

SEQ ID NO: 25266 - DNA, 24 bp, Homo sapiens
aagaagccgagatcatcaggaagt

SEQ ID NO: 25267 - DNA, 24 bp, Homo sapiens
acacagtgcgtatgacttggaagt

SEQ ID NO: 25268 - DNA, 24 bp, Homo sapiens
aagatagagcgtgaaggcgaatgc

SEQ ID NO: 25269 - DNA, 24 bp, Homo sapiens
aatccacaaaggtggtgatgtgct

SEQ ID NO: 25270 - DNA, 24 bp, Homo sapiens
taatccacaaaggtggtgatgtgc

SEQ ID NO: 25271 - DNA, 24 bp, Homo sapiens
ctaatccacaaaggtggtgatgtg

SEQ ID NO: 25272 - DNA, 24 bp, Homo sapiens
tgtgtcaagcgatggtcagcaatg

SEQ ID NO: 25273 - DNA, 25 bp, Homo sapiens
tggagaaacacccttgactttggca

SEQ ID NO: 25274 - DNA, 25 bp, Homo sapiens
agaatccattgaagccagcaagact

SEQ ID NO: 25275 - DNA, 23 bp, Homo sapiens
tgaggcagcaggaggtggcaatc

SEQ ID NO: 25276 - DNA, 24 bp, Homo sapiens
acctaaccgagcaggacatcttcc

SEQ ID NO: 25277 - DNA, 25 bp, Homo sapiens
acaccaattcactcagcagcagatg

SEQ ID NO: 25278 - DNA, 24 bp, Homo sapiens
acctaaccgagcaggacatcttcc

SEQ ID NO: 25279 - DNA, 23 bp, Homo sapiens
gaggcagcaggaggtggcaatcc

SEQ ID NO: 25280 - DNA, 24 bp, Homo sapiens
cctgctggaatatggaggaagcgg

SEQ ID NO: 25281 - DNA, 25 bp, Homo sapiens
tcaactgctctcactgaggtcgtca

SEQ ID NO: 25282 - DNA, 24 bp, Homo sapiens
aaggtatagcagtcttggcagttg

SEQ ID NO: 25283 - DNA, 25 bp, Homo sapiens
aattcctggctgatttccttactgc

SEQ ID NO: 25284 - DNA, 24 bp, Homo sapiens
cgccacatcagcccctgcagctct

SEQ ID NO: 25285 - DNA, 24 bp, Homo sapiens
ccgccacatcagcccctgcagctc

SEQ ID NO: 25286 - DNA, 24 bp, Homo sapiens
tccgccacatcagcccctgcagct

SEQ ID NO: 25287 - DNA, 24 bp, Homo sapiens
atatattataggagatgagaatga

SEQ ID NO: 25288 - DNA, 24 bp, Homo sapiens
tatatattataggagatgagaatg

SEQ ID NO: 25289 - DNA, 24 bp, Homo sapiens
ttatatattataggagatgagaat

SEQ ID NO: 25290 - DNA, 24 bp, Homo sapiens
catcaagaatggtaaataattttt

SEQ ID NO: 25291 - DNA, 24 bp, Homo sapiens
acatcaagaatggtaaataatttt

SEQ ID NO: 25292 - DNA, 24 bp, Homo sapiens
aacatcaagaatggtaaataattt

SEQ ID NO: 25293 - DNA, 24 bp, Homo sapiens
tacttaatactgtaagtattatga

SEQ ID NO: 25294 - DNA, 24 bp, Homo sapiens
ttacttaatactgtaagtattatg

SEQ ID NO: 25295 - DNA, 24 bp, Homo sapiens
cttacttaatactgtaagtattat

SEQ ID NO: 25296 - DNA, 23 bp, Homo sapiens
gccagcagcactcggaacagatg

SEQ ID NO: 25297 - DNA, 25 bp, Homo sapiens
aaagataactaatcacttagagaga

SEQ ID NO: 25298 - DNA, 23 bp, Homo sapiens
gccagcagcactcggaacagatg

SEQ ID NO: 25299 - DNA, 25 bp, Homo sapiens
accatcaacatcaacacctccacct

SEQ ID NO: 25300 - DNA, 24 bp, Homo sapiens
catgatgttgaagagctgcgacgc

SEQ ID NO: 25301 - DNA, 24 bp, Homo sapiens
atcagctaatgtgaatgaatttcc

SEQ ID NO: 25302 - DNA, 24 bp, Homo sapiens
aatcagctaatgtgaatgaatttc

SEQ ID NO: 25303 - DNA, 24 bp, Homo sapiens
aaatcagctaatgtgaatgaattt

SEQ ID NO: 25304 - DNA, 24 bp, Homo sapiens
aatatgatttgttggtaagtaatg

SEQ ID NO: 25305 - DNA, 24 bp, Homo sapiens
aaatatgatttgttggtaagtaat

SEQ ID NO: 25306 - DNA, 24 bp, Homo sapiens
taaatatgatttgttggtaagtaa

SEQ ID NO: 25307 - DNA, 24 bp, Homo sapiens
aaacacagaagtgaatgaatttcc

SEQ ID NO: 25308 - DNA, 24 bp, Homo sapiens
caaacacagaagtgaatgaatttc

SEQ ID NO: 25309 - DNA, 24 bp, Homo sapiens
ccaaacacagaagtgaatgaattt

SEQ ID NO: 25310 - DNA, 23 bp, Homo sapiens
tcggcgtgtgtcaagtaggcaac

SEQ ID NO: 25311 - DNA, 25 bp, Homo sapiens
tgtcatatcctcggaagcccattgc

SEQ ID NO: 25312 - DNA, 23 bp, Homo sapiens
gagaggctgggcagagaccactg

SEQ ID NO: 25313 - DNA, 24 bp, Homo sapiens
tgcactcacagggaggcatctgta

SEQ ID NO: 25314 - DNA, 24 bp, Homo sapiens
ttgcactcacagggaggcatctgt

SEQ ID NO: 25315 - DNA, 24 bp, Homo sapiens
tttgcactcacagggaggcatctg

SEQ ID NO: 25316 - DNA, 24 bp, Homo sapiens
ggacagaacggcggctggtgaacc

SEQ ID NO: 25317 - DNA, 24 bp, Homo sapiens
tacctggaggccaagaggctgttg

SEQ ID NO: 25318 - DNA, 24 bp, Homo sapiens
ttccaggcacgttaccggcagctg

SEQ ID NO: 25319 - DNA, 24 bp, Homo sapiens
cggaggcaggcaaagaaacaagtg

SEQ ID NO: 25320 - DNA, 24 bp, Homo sapiens
ccgcagacccctcggaggctgaag

SEQ ID NO: 25321 - DNA, 24 bp, Homo sapiens
cgcgcatccctcctgactgggacg

SEQ ID NO: 25322 - DNA, 24 bp, Homo sapiens
ggtgaaccacaagcagtacctgga

SEQ ID NO: 25323 - DNA, 24 bp, Homo sapiens
gaggctgttgaaggagttccaggc

SEQ ID NO: 25324 - DNA, 24 bp, Homo sapiens
gctcaaatgatcctcctgcctccc

SEQ ID NO: 25325 - DNA, 23 bp, Homo sapiens
ccacctccaccaccatcacagga

SEQ ID NO: 25326 - DNA, 24 bp, Homo sapiens
catccagcggcttctgtccaacat

SEQ ID NO: 25327 - DNA, 25 bp, Homo sapiens
acaagtgctagaacaagtccagtct

SEQ ID NO: 25328 - DNA, 24 bp, Homo sapiens
actacaagcagcagtatgatatta

SEQ ID NO: 25329 - DNA, 24 bp, Homo sapiens
tactacaagcagcagtatgatatt

SEQ ID NO: 25330 - DNA, 24 bp, Homo sapiens
ttactacaagcagcagtatgatat

SEQ ID NO: 25331 - DNA, 24 bp, Homo sapiens
tcagactgccagagtgttgcttca

SEQ ID NO: 25332 - DNA, 24 bp, Homo sapiens
aagccttggtctgtggacaactag

SEQ ID NO: 25333 - DNA, 24 bp, Homo sapiens
tatagcagcagcccagacagcaca

SEQ ID NO: 25334 - DNA, 23 bp, Homo sapiens
gctggtgctgctcggacactctc

SEQ ID NO: 25335 - DNA, 23 bp, Homo sapiens
gtgtgccacctacaagctgtgcc

SEQ ID NO: 25336 - DNA, 23 bp, Homo sapiens
gcttcctgctcaagtgcttagag

SEQ ID NO: 25337 - DNA, 25 bp, Homo sapiens
cagtctcagttgtggtcagcactct

SEQ ID NO: 25338 - DNA, 23 bp, Homo sapiens
actggctggtgctggacaactgt

SEQ ID NO: 25339 - DNA, 25 bp, Homo sapiens
gctcttgctggaactgttaggcaga

SEQ ID NO: 25340 - DNA, 23 bp, Homo sapiens
gccgaggacagtgcagccgagtt

SEQ ID NO: 25341 - DNA, 25 bp, Homo sapiens
gactttctgggctctggatggttcg

SEQ ID NO: 25342 - DNA, 23 bp, Homo sapiens
ctcctcagccccgcagccccgca

SEQ ID NO: 25343 - DNA, 23 bp, Homo sapiens
gtgccgtccaaaccgttccgtta

SEQ ID NO: 25344 - DNA, 23 bp, Homo sapiens
ttgaccacgctatgctccaagcc

SEQ ID NO: 25345 - DNA, 23 bp, Homo sapiens
tttgccctgctctgcctgccctg

SEQ ID NO: 25346 - DNA, 24 bp, Homo sapiens
ttatttttcagttggaaaatggtt

SEQ ID NO: 25347 - DNA, 24 bp, Homo sapiens
tttatttttcagttggaaaatggt

SEQ ID NO: 25348 - DNA, 24 bp, Homo sapiens
ctttatttttcagttggaaaatgg

SEQ ID NO: 25349 - DNA, 24 bp, Homo sapiens
cagtggcacagtggcacaatctca

SEQ ID NO: 25350 - DNA, 24 bp, Homo sapiens
attacaggtgtgagcaaccacgcc

SEQ ID NO: 25351 - DNA, 24 bp, Homo sapiens
tgtcctctaagtgttacgcaactc

SEQ ID NO: 25352 - DNA, 24 bp, Homo sapiens
tgtagtagaagggtcagccagagg

SEQ ID NO: 25353 - DNA, 24 bp, Homo sapiens
cctatggaggtggagagcagaatg

SEQ ID NO: 25354 - DNA, 24 bp, Homo sapiens
tactgagcaactgacagaggaagt

SEQ ID NO: 25355 - DNA, 24 bp, Homo sapiens
cttatctaatggctcagtgctctt

SEQ ID NO: 25356 - DNA, 24 bp, Homo sapiens
tcttatctaatggctcagtgctct

SEQ ID NO: 25357 - DNA, 24 bp, Homo sapiens
ctcttatctaatggctcagtgctc

SEQ ID NO: 25358 - DNA, 24 bp, Homo sapiens
gcagtggcacgatctcagctcatt

SEQ ID NO: 25359 - DNA, 25 bp, Homo sapiens
gggattacagatgggaccacctagt

SEQ ID NO: 25360 - DNA, 25 bp, Homo sapiens
ccactgattctacattatgacctgc

SEQ ID NO: 25361 - DNA, 23 bp, Homo sapiens
cacccgcctcagcctcccaaagt

SEQ ID NO: 25362 - DNA, 23 bp, Homo sapiens
gcccagccgtcacaggatttcat

SEQ ID NO: 25363 - DNA, 25 bp, Homo sapiens
ccctctttcttctttaggattccca

SEQ ID NO: 25364 - DNA, 24 bp, Homo sapiens
tttataaaaatctgctgtatcttg

SEQ ID NO: 25365 - DNA, 24 bp, Homo sapiens
ctttataaaaatctgctgtatctt

SEQ ID NO: 25366 - DNA, 24 bp, Homo sapiens
actttataaaaatctgctgtatct

SEQ ID NO: 25367 - DNA, 24 bp, Homo sapiens
ccatagttaatgcctcaaaacttc

SEQ ID NO: 25368 - DNA, 24 bp, Homo sapiens
tccatagttaatgcctcaaaactt

SEQ ID NO: 25369 - DNA, 24 bp, Homo sapiens
gtccatagttaatgcctcaaaact

SEQ ID NO: 25370 - DNA, 24 bp, Homo sapiens
aaaagtaaaatatatgcttcttct

SEQ ID NO: 25371 - DNA, 24 bp, Homo sapiens
taaaagtaaaatatatgcttcttc

SEQ ID NO: 25372 - DNA, 24 bp, Homo sapiens
ttaaaagtaaaatatatgcttctt

SEQ ID NO: 25373 - DNA, 25 bp, Homo sapiens
aaatcctgattttgtaagaaagttt

SEQ ID NO: 25374 - DNA, 23 bp, Homo sapiens
gactacttttttgaagaaagaga

SEQ ID NO: 25375 - DNA, 24 bp, Homo sapiens
ctcactgtagcctccaactcttgt

SEQ ID NO: 25376 - DNA, 24 bp, Homo sapiens
acgcagcatttcagggactggatg

SEQ ID NO: 25377 - DNA, 24 bp, Homo sapiens
ccaggctggagtgcagtggtacaa

SEQ ID NO: 25378 - DNA, 24 bp, Homo sapiens
ttttctttcaggattaaatggttt

SEQ ID NO: 25379 - DNA, 24 bp, Homo sapiens
cttttctttcaggattaaatggtt

SEQ ID NO: 25380 - DNA, 24 bp, Homo sapiens
gcttttctttcaggattaaatggt

SEQ ID NO: 25381 - DNA, 25 bp, Homo sapiens
agcaacttcgttccagtgaatgaca

SEQ ID NO: 25382 - DNA, 25 bp, Homo sapiens
tgtagacctgtccttccaactggca

SEQ ID NO: 25383 - DNA, 25 bp, Homo sapiens
gtgtggaggaatatgtgctgccgaa

SEQ ID NO: 25384 - DNA, 24 bp, Homo sapiens
aacttcagctggtaatattttatt

SEQ ID NO: 25385 - DNA, 24 bp, Homo sapiens
caacttcagctggtaatattttat

SEQ ID NO: 25386 - DNA, 24 bp, Homo sapiens
caacttcagctggtaatattttat

SEQ ID NO: 25387 - DNA, 24 bp, Homo sapiens
attgattttagcagagaaacattc

SEQ ID NO: 25388 - DNA, 24 bp, Homo sapiens
tattgattttagcagagaaacatt

SEQ ID NO: 25389 - DNA, 24 bp, Homo sapiens
tattgattttagcagagaaacatt

SEQ ID NO: 25390 - DNA, 25 bp, Homo sapiens
agactgaacgaatacaaccaacttc

SEQ ID NO: 25391 - DNA, 24 bp, Homo sapiens
gcccaggagcaaattcgcagaatg

SEQ ID NO: 25392 - DNA, 23 bp, Homo sapiens
gctcaaccaacttgctgcctacc

SEQ ID NO: 25393 - DNA, 24 bp, Homo sapiens
tatatctttagcagaaagttgaga

SEQ ID NO: 25394 - DNA, 24 bp, Homo sapiens
atatatctttagcagaaagttgag

SEQ ID NO: 25395 - DNA, 24 bp, Homo sapiens
gatatatctttagcagaaagttga

SEQ ID NO: 25396 - DNA, 24 bp, Homo sapiens
ccttactaaaggtatggctttttt

SEQ ID NO: 25397 - DNA, 24 bp, Homo sapiens
tccttactaaaggtatggcttttt

SEQ ID NO: 25398 - DNA, 24 bp, Homo sapiens
ttccttactaaaggtatggctttt

SEQ ID NO: 25399 - DNA, 24 bp, Homo sapiens
gcggctctggttcctgttcctcta

SEQ ID NO: 25400 - DNA, 23 bp, Homo sapiens
gttccgccgccctatccctcctc

SEQ ID NO: 25401 - DNA, 23 bp, Homo sapiens
cctgcccactcctgcccgctaac

SEQ ID NO: 25402 - DNA, 24 bp, Homo sapiens
gaaagaaaggcgtaggctgggcat

SEQ ID NO: 25403 - DNA, 23 bp, Homo sapiens
ttcaagaccaacctggctaacat

SEQ ID NO: 25404 - DNA, 23 bp, Homo sapiens
ccgaggcaggcggatcacgaggt

SEQ ID NO: 25405 - DNA, 24 bp, Homo sapiens
cattttggcatgtcattgtggaaa

SEQ ID NO: 25406 - DNA, 24 bp, Homo sapiens
gcattttggcatgtcattgtggaa

SEQ ID NO: 25407 - DNA, 24 bp, Homo sapiens
tgcattttggcatgtcattgtgga

SEQ ID NO: 25408 - DNA, 23 bp, Homo sapiens
ggacggagaggagcagagaagca

SEQ ID NO: 25409 - DNA, 25 bp, Homo sapiens
agaagttggaacgatgctggtcacc

SEQ ID NO: 25410 - DNA, 25 bp, Homo sapiens
tgctcacctccttcttctcgttcct

SEQ ID NO: 25411 - DNA, 25 bp, Homo sapiens
tccgacaccaaatctatccgagcct

SEQ ID NO: 25412 - DNA, 23 bp, Homo sapiens
gctgccagtgaaatccgagtgga

SEQ ID NO: 25413 - DNA, 23 bp, Homo sapiens
cccaggtgctggtgcggaaattg

SEQ ID NO: 25414 - DNA, 23 bp, Homo sapiens
agactccacatgacgggcacctt

SEQ ID NO: 25415 - DNA, 23 bp, Homo sapiens
ccctcatcgcagcctgaaagtgg

SEQ ID NO: 25416 - DNA, 25 bp, Homo sapiens
gcacaaggctgagctgaagatggat

SEQ ID NO: 25417 - DNA, 24 bp, Homo sapiens
gtcctgctccaaagtgactgacag

SEQ ID NO: 25418 - DNA, 23 bp, Homo sapiens
gcccccacccccgccacctccca

SEQ ID NO: 25419 - DNA, 23 bp, Homo sapiens
acacgtctgccagtgccggcccc

SEQ ID NO: 25420 - DNA, 23 bp, Homo sapiens
acgcagccagatgagcaactgac

SEQ ID NO: 25421 - DNA, 24 bp, Homo sapiens
gccagggcagagatcaacgaattt

SEQ ID NO: 25422 - DNA, 25 bp, Homo sapiens
acagcagctctggttgaagaagtgt

SEQ ID NO: 25423 - DNA, 24 bp, Homo sapiens
aaagttcaaaaatctcaaatacaa

SEQ ID NO: 25424 - DNA, 24 bp, Homo sapiens
aaaagttcaaaaatctcaaataca

SEQ ID NO: 25425 - DNA, 24 bp, Homo sapiens
aaaaagttcaaaaatctcaaatac

SEQ ID NO: 25426 - DNA, 25 bp, Homo sapiens
tcttatactctgaagggactcgtga

SEQ ID NO: 25427 - DNA, 23 bp, Homo sapiens
tgagccaccgcgcccggccgatt

SEQ ID NO: 25428 - DNA, 24 bp, Homo sapiens
tgatgttaaatgaataagaatctt

SEQ ID NO: 25429 - DNA, 24 bp, Homo sapiens
atgatgttaaatgaataagaatct

SEQ ID NO: 25430 - DNA, 24 bp, Homo sapiens
gatgatgttaaatgaataagaatc

SEQ ID NO: 25431 - DNA, 24 bp, Homo sapiens
ttgctcttgtggtaataattaaaa

SEQ ID NO: 25432 - DNA, 24 bp, Homo sapiens
tttgctcttgtggtaataattaaa

SEQ ID NO: 25433 - DNA, 24 bp, Homo sapiens
ctttgctcttgtggtaataattaa

SEQ ID NO: 25434 - DNA, 25 bp, Homo sapiens
tggaattttggttgggaattttagt

SEQ ID NO: 25435 - DNA, 25 bp, Homo sapiens
aatattttcctacttcttacaagaa

SEQ ID NO: 25436 - DNA, 25 bp, Homo sapiens
ctcatcatttttgattggattaata

SEQ ID NO: 25437 - DNA, 23 bp, Homo sapiens
cttccacgccagcctcccgcatc

SEQ ID NO: 25438 - DNA, 25 bp, Homo sapiens
ggcaatacttctcccagagcgatct

SEQ ID NO: 25439 - DNA, 25 bp, Homo sapiens
gagaggaaggtgagtatgaggctgc

SEQ ID NO: 25440 - DNA, 23 bp, Homo sapiens
tgtctgggatgctggtgcctgta

SEQ ID NO: 25441 - DNA, 24 bp, Homo sapiens
ctggagccttgttcatcttgggag

SEQ ID NO: 25442 - DNA, 25 bp, Homo sapiens
acagcattaaggttatgaatcgccg

SEQ ID NO: 25443 - DNA, 25 bp, Homo sapiens
aagcagacacagaccacaggacaac

SEQ ID NO: 25444 - DNA, 25 bp, Homo sapiens
actgcgactccttctctgactgttg

SEQ ID NO: 25445 - DNA, 24 bp, Homo sapiens
ggagaagccttcgcagatgacagc

SEQ ID NO: 25446 - DNA, 24 bp, Homo sapiens
tgagacagaagatgagattgaaat

SEQ ID NO: 25447 - DNA, 24 bp, Homo sapiens
ctgagacagaagatgagattgaaa

SEQ ID NO: 25448 - DNA, 24 bp, Homo sapiens
cctgagacagaagatgagattgaa

SEQ ID NO: 25449 - DNA, 23 bp, Homo sapiens
cgctagggctccccgtgaagaag

SEQ ID NO: 25450 - DNA, 23 bp, Homo sapiens
tgctgctgctggcggcgctgctg

SEQ ID NO: 25451 - DNA, 23 bp, Homo sapiens
gcagcctcggaaccgagacgatg

SEQ ID NO: 25452 - DNA, 24 bp, Homo sapiens
agaggcaccagaatccctgtaacc

SEQ ID NO: 25453 - DNA, 24 bp, Homo sapiens
tagaggcaccagaatccctgtaac

SEQ ID NO: 25454 - DNA, 24 bp, Homo sapiens
ttagaggcaccagaatccctgtaa

SEQ ID NO: 25455 - DNA, 24 bp, Homo sapiens
ctgtgctgaggtcaagtggagtgg

SEQ ID NO: 25456 - DNA, 24 bp, Homo sapiens
ggttcaagcgattcttctgcctgg

SEQ ID NO: 25457 - DNA, 25 bp, Homo sapiens
ccgagaagcgacacatctgaagagt

SEQ ID NO: 25458 - DNA, 23 bp, Homo sapiens
ccaacatcatcacactggcagac

SEQ ID NO: 25459 - DNA, 25 bp, Homo sapiens
cgagaatactgggattacgagtcac

SEQ ID NO: 25460 - DNA, 23 bp, Homo sapiens
gctttgtccgccaacctgtctga

SEQ ID NO: 25461 - DNA, 23 bp, Homo sapiens
aagggacttggagggaagcgggc

SEQ ID NO: 25462 - DNA, 23 bp, Homo sapiens
ctgctgccgccgcccctgagctc

SEQ ID NO: 25463 - DNA, 23 bp, Homo sapiens
gaaggctggccccgtccccgggc

SEQ ID NO: 25464 - DNA, 25 bp, Homo sapiens
gccattacctgcctcttgatgaagc

SEQ ID NO: 25465 - DNA, 25 bp, Homo sapiens
aagcgattcttgtgcctcagattcc

SEQ ID NO: 25466 - DNA, 25 bp, Homo sapiens
ggacttccagactccagaactgctg

SEQ ID NO: 25467 - DNA, 24 bp, Homo sapiens
cagtctttctggcaaagtagaaaa

SEQ ID NO: 25468 - DNA, 24 bp, Homo sapiens
tcagtctttctggcaaagtagaaa

SEQ ID NO: 25469 - DNA, 24 bp, Homo sapiens
tcagtctttctggcaaagtagaaa

SEQ ID NO: 25470 - DNA, 24 bp, Homo sapiens
cagtctttctgaaaattcatttgc

SEQ ID NO: 25471 - DNA, 24 bp, Homo sapiens
tcagtctttctgaaaattcatttg

SEQ ID NO: 25472 - DNA, 24 bp, Homo sapiens
gtcagtctttctgaaaattcattt

SEQ ID NO: 25473 - DNA, 24 bp, Homo sapiens
tcgtcttcatggattcccagccca

SEQ ID NO: 25474 - DNA, 24 bp, Homo sapiens
gagcacgcggccaggcagagaagg

SEQ ID NO: 25475 - DNA, 24 bp, Homo sapiens
gaggggttgggctcccgctccacc

SEQ ID NO: 25476 - DNA, 24 bp, Homo sapiens
tatcactcaaggttagtcattaat

SEQ ID NO: 25477 - DNA, 24 bp, Homo sapiens
atatcactcaaggttagtcattaa

SEQ ID NO: 25478 - DNA, 24 bp, Homo sapiens
tatatcactcaaggttagtcatta

SEQ ID NO: 25479 - DNA, 24 bp, Homo sapiens
agtgaaaaaaggttcagtatctga

SEQ ID NO: 25480 - DNA, 24 bp, Homo sapiens
aagtgaaaaaaggttcagtatctg

SEQ ID NO: 25481 - DNA, 24 bp, Homo sapiens
taagtgaaaaaaggttcagtatct

SEQ ID NO: 25482 - DNA, 24 bp, Homo sapiens
tgccttccacttcttccatctgcc

SEQ ID NO: 25483 - DNA, 24 bp, Homo sapiens
ggagaactgaagagtctgagagcg

SEQ ID NO: 25484 - DNA, 24 bp, Homo sapiens
actgccctcctacactccaccttg

SEQ ID NO: 25485 - DNA, 23 bp, Homo sapiens
gctaccgccagcactaggacctg

SEQ ID NO: 25486 - DNA, 23 bp, Homo sapiens
gctggctggctggcagatggtag

SEQ ID NO: 25487 - DNA, 23 bp, Homo sapiens
tgccaggaagatgatgccacgat

SEQ ID NO: 25488 - DNA, 25 bp, Homo sapiens
ggaaccaatagatgtcacaactggc

SEQ ID NO: 25489 - DNA, 24 bp, Homo sapiens
gatggaaagtgttgagaaagattg

SEQ ID NO: 25490 - DNA, 24 bp, Homo sapiens
agatggaaagtgttgagaaagatt

SEQ ID NO: 25491 - DNA, 24 bp, Homo sapiens
aagatggaaagtgttgagaaagat

SEQ ID NO: 25492 - DNA, 24 bp, Homo sapiens
aagaaacagaggtgataagaaaag

SEQ ID NO: 25493 - DNA, 24 bp, Homo sapiens
taagaaacagaggtgataagaaaa

SEQ ID NO: 25494 - DNA, 24 bp, Homo sapiens
ttaagaaacagaggtgataagaaa

SEQ ID NO: 25495 - DNA, 23 bp, Homo sapiens
gctgctgctacttgctgtcctgg

SEQ ID NO: 25496 - DNA, 25 bp, Homo sapiens
cttggtgttgtcgcaggagagtgag

SEQ ID NO: 25497 - DNA, 23 bp, Homo sapiens
gacatcttcactctcctgctgcg

SEQ ID NO: 25498 - DNA, 24 bp, Homo sapiens
tggtggagctggtctcgttggtct

SEQ ID NO: 25499 - DNA, 24 bp, Homo sapiens
ctggtggagctggtctcgttggtc

SEQ ID NO: 25500 - DNA, 24 bp, Homo sapiens
cctggtggagctggtctcgttggt

SEQ ID NO: 25501 - DNA, 24 bp, Homo sapiens
tgtgaaaaaagggtggttgtactg

SEQ ID NO: 25502 - DNA, 24 bp, Homo sapiens
ctgtgaaaaaagggtggttgtact

SEQ ID NO: 25503 - DNA, 24 bp, Homo sapiens
tctgtgaaaaaagggtggttgtac

SEQ ID NO: 25504 - DNA, 24 bp, Homo sapiens
cccacagcaaagaatgatccggtc

SEQ ID NO: 25505 - DNA, 24 bp, Homo sapiens
tgctgctaaacatcctgcaatgca

SEQ ID NO: 25506 - DNA, 24 bp, Homo sapiens
tcaaagtgttgaagttgagaaagc

SEQ ID NO: 25507 - DNA, 24 bp, Homo sapiens
gctgcggaagtgctgtgacagttt

SEQ ID NO: 25508 - DNA, 24 bp, Homo sapiens
ttcagtcatggcaggacacgctgg

SEQ ID NO: 25509 - DNA, 24 bp, Homo sapiens
ggattgtacctcctgaccgacgga

SEQ ID NO: 25510 - DNA, 24 bp, Homo sapiens
tcagaattcaggtaactaaaatat

SEQ ID NO: 25511 - DNA, 24 bp, Homo sapiens
ctcagaattcaggtaactaaaata

SEQ ID NO: 25512 - DNA, 24 bp, Homo sapiens
tctcagaattcaggtaactaaaat

SEQ ID NO: 25513 - DNA, 25 bp, Homo sapiens
acaccttcactggctaagagtatgg

SEQ ID NO: 25514 - DNA, 23 bp, Homo sapiens
gcgtgcctgatagttgaggagcc

SEQ ID NO: 25515 - DNA, 23 bp, Homo sapiens
tggtcaggctggtctccaactcc

SEQ ID NO: 25516 - DNA, 23 bp, Homo sapiens
ggagcagaaccacagcctgaagg

SEQ ID NO: 25517 - DNA, 25 bp, Homo sapiens
aagcctgtctcttgaggaacaaccg

SEQ ID NO: 25518 - DNA, 23 bp, Homo sapiens
cctgcctcttctgaccacacgac

SEQ ID NO: 25519 - DNA, 24 bp, Homo sapiens
ctgcactcactgaagccgtaaggt

SEQ ID NO: 25520 - DNA, 24 bp, Homo sapiens
caacctgctgtggctggctgagac

SEQ ID NO: 25521 - DNA, 24 bp, Homo sapiens
tgttagacacagaagaggaggtgc

SEQ ID NO: 25522 - DNA, 24 bp, Homo sapiens
gcctggagctggttctgctggtgg

SEQ ID NO: 25523 - DNA, 24 bp, Homo sapiens
tgcctggagctggttctgctggtg

SEQ ID NO: 25524 - DNA, 24 bp, Homo sapiens
atgcctggagctggttctgctggt

SEQ ID NO: 25525 - DNA, 24 bp, Homo sapiens
ctaggagccagccagccccgggcg

SEQ ID NO: 25526 - DNA, 24 bp, Homo sapiens
gctaggagccagccagccccgggc

SEQ ID NO: 25527 - DNA, 24 bp, Homo sapiens
agctaggagccagccagccccggg

SEQ ID NO: 25528 - DNA, 24 bp, Homo sapiens
ggtggcgaggactgtgtggtgatg

SEQ ID NO: 25529 - DNA, 24 bp, Homo sapiens
ggagaatgcctcactcatcggtgc

SEQ ID NO: 25530 - DNA, 24 bp, Homo sapiens
gccaagaacaatgtccatgccact

SEQ ID NO: 25531 - DNA, 23 bp, Homo sapiens
ctggaggagctggagctgaccaa

SEQ ID NO: 25532 - DNA, 23 bp, Homo sapiens
ccgctgcctcgtcattgagtagc

SEQ ID NO: 25533 - DNA, 23 bp, Homo sapiens
agccacagccgccgccatcactc

SEQ ID NO: 25534 - DNA, 25 bp, Homo sapiens
ctcttccactccagcaatgtcatcg

SEQ ID NO: 25535 - DNA, 23 bp, Homo sapiens
ttctgctgctggtggttggcttc

SEQ ID NO: 25536 - DNA, 23 bp, Homo sapiens
tcctgtggctgtctgtggtctcc

SEQ ID NO: 25537 - DNA, 24 bp, Homo sapiens
aagagtaccaggtgggcctaggat

SEQ ID NO: 25538 - DNA, 24 bp, Homo sapiens
gaagagtaccaggtgggcctagga

SEQ ID NO: 25539 - DNA, 24 bp, Homo sapiens
ggaagagtaccaggtgggcctagg

SEQ ID NO: 25540 - DNA, 24 bp, Homo sapiens
ggaggagcctgagccacggttgga

SEQ ID NO: 25541 - DNA, 24 bp, Homo sapiens
aggaggagcctgagccacggttgg

SEQ ID NO: 25542 - DNA, 24 bp, Homo sapiens
aaggaggagcctgagccacggttg

SEQ ID NO: 25543 - DNA, 24 bp, Homo sapiens
tatatccttaggtgtctctcctgt

SEQ ID NO: 25544 - DNA, 24 bp, Homo sapiens
gtatatccttaggtgtctctcctg

SEQ ID NO: 25545 - DNA, 24 bp, Homo sapiens
cgtatatccttaggtgtctctcct

SEQ ID NO: 25546 - DNA, 25 bp, Homo sapiens
gtcattgtggtcaactgctctgagg

SEQ ID NO: 25547 - DNA, 23 bp, Homo sapiens
caggcacaggcaagaccgagacc

SEQ ID NO: 25548 - DNA, 25 bp, Homo sapiens
tacatgacactgaccacggcattgc

SEQ ID NO: 25549 - DNA, 23 bp, Homo sapiens
atctagaagaggcactgcccgcc

SEQ ID NO: 25550 - DNA, 23 bp, Homo sapiens
tcaggcactggctgacaatgccc

SEQ ID NO: 25551 - DNA, 23 bp, Homo sapiens
gaaaagattgcagttgaggaaat

SEQ ID NO: 25552 - DNA, 24 bp, Homo sapiens
gtccccggcagctacgcccatgcg

SEQ ID NO: 25553 - DNA, 24 bp, Homo sapiens
tgtccccggcagctacgcccatgc

SEQ ID NO: 25554 - DNA, 24 bp, Homo sapiens
gtgtccccggcagctacgcccatg

SEQ ID NO: 25555 - DNA, 24 bp, Homo sapiens
gctttattgcaggtggatgtgcca

SEQ ID NO: 25556 - DNA, 24 bp, Homo sapiens
agctttattgcaggtggatgtgcc

SEQ ID NO: 25557 - DNA, 24 bp, Homo sapiens
cagctttattgcaggtggatgtgc

SEQ ID NO: 25558 - DNA, 24 bp, Homo sapiens
cctgtgtcttcctggcaactgctg

SEQ ID NO: 25559 - DNA, 23 bp, Homo sapiens
agcagcagagagcagagagcact

SEQ ID NO: 25560 - DNA, 25 bp, Homo sapiens
atcttcagtggctacaggcagttcc

SEQ ID NO: 25561 - DNA, 25 bp, Homo sapiens
agcatagttggcatttccctggtcc

SEQ ID NO: 25562 - DNA, 23 bp, Homo sapiens
caggctgtcatctacgaggtggc

SEQ ID NO: 25563 - DNA, 23 bp, Homo sapiens
ggctgctcagtgtggtggatctc

SEQ ID NO: 25564 - DNA, 24 bp, Homo sapiens
atctcattcagtttcagggtctag

SEQ ID NO: 25565 - DNA, 24 bp, Homo sapiens
catctcattcagtttcagggtcta

SEQ ID NO: 25566 - DNA, 24 bp, Homo sapiens
ccatctcattcagtttcagggtct

SEQ ID NO: 25567 - DNA, 24 bp, Homo sapiens
gcccagcagacaccggagagcaat

SEQ ID NO: 25568 - DNA, 24 bp, Homo sapiens
cgcccagcagacaccggagagcaa

SEQ ID NO: 25569 - DNA, 24 bp, Homo sapiens
ccgcccagcagacaccggagagca

SEQ ID NO: 25570 - DNA, 24 bp, Homo sapiens
ggttcaagcgattctcctgcctca

SEQ ID NO: 25571 - DNA, 24 bp, Homo sapiens
ccctcatttctcctcctccgctgg

SEQ ID NO: 25572 - DNA, 24 bp, Homo sapiens
gcagtggcacagtcttggctcacc

SEQ ID NO: 25573 - DNA, 24 bp, Homo sapiens
ggaactcttcagaccaggagcagt

SEQ ID NO: 25574 - DNA, 24 bp, Homo sapiens
gcctagagcccttcaagaggagag

SEQ ID NO: 25575 - DNA, 24 bp, Homo sapiens
caccctcccagccagccctgcacc

SEQ ID NO: 25576 - DNA, 24 bp, Homo sapiens
aggagacagacagagaaggcagca

SEQ ID NO: 25577 - DNA, 24 bp, Homo sapiens
ctttgttgctcagcaaggggctct

SEQ ID NO: 25578 - DNA, 24 bp, Homo sapiens
ccttggggaaggtctccccatgtg

SEQ ID NO: 25579 - DNA, 23 bp, Homo sapiens
gagggagcaggagcggccagtgc

SEQ ID NO: 25580 - DNA, 23 bp, Homo sapiens
cacccccggcccggcatcccccg

SEQ ID NO: 25581 - DNA, 23 bp, Homo sapiens
cgccaggcccggcgggcgggagc

SEQ ID NO: 25582 - DNA, 24 bp, Homo sapiens
ttttacaacagattcattttattt

SEQ ID NO: 25583 - DNA, 24 bp, Homo sapiens
cttttacaacagattcattttatt

SEQ ID NO: 25584 - DNA, 24 bp, Homo sapiens
ccttttacaacagattcattttat

SEQ ID NO: 25585 - DNA, 25 bp, Homo sapiens
tccttgtggctttgtatgttcacca

SEQ ID NO: 25586 - DNA, 25 bp, Homo sapiens
aggcacacagaactccatcaagacg

SEQ ID NO: 25587 - DNA, 25 bp, Homo sapiens
tcctccatcttcaaattatatccgc

SEQ ID NO: 25588 - DNA, 24 bp, Homo sapiens
catgtacacagggaccccctggtt

SEQ ID NO: 25589 - DNA, 24 bp, Homo sapiens
ccatgtacacagggaccccctggt

SEQ ID NO: 25590 - DNA, 24 bp, Homo sapiens
cccatgtacacagggaccccctgg

SEQ ID NO: 25591 - DNA, 23 bp, Homo sapiens
ctgctcctggcgttgggacacac

SEQ ID NO: 25592 - DNA, 23 bp, Homo sapiens
ctgatggtgccgccgcctccgag

SEQ ID NO: 25593 - DNA, 23 bp, Homo sapiens
agctgggcaggagcctgggtccg

SEQ ID NO: 25594 - DNA, 25 bp, Homo sapiens
gcgacgactaaatacccgtgtctga

SEQ ID NO: 25595 - DNA, 23 bp, Homo sapiens
cggaggacggcgacagagaaatc

SEQ ID NO: 25596 - DNA, 23 bp, Homo sapiens
gctgctgctgctcctggcgttgg

SEQ ID NO: 25597 - DNA, 23 bp, Homo sapiens
gtccgagatgagcaaccgcacca

SEQ ID NO: 25598 - DNA, 23 bp, Homo sapiens
aagtgcctggtggtgtgcgactc

SEQ ID NO: 25599 - DNA, 23 bp, Homo sapiens
cgcagaacgacacggagcccatc

SEQ ID NO: 25600 - DNA, 24 bp, Homo sapiens
tcattctaatggtaagtagaattt

SEQ ID NO: 25601 - DNA, 24 bp, Homo sapiens
atcattctaatggtaagtagaatt

SEQ ID NO: 25602 - DNA, 24 bp, Homo sapiens
gatcattctaatggtaagtagaat

SEQ ID NO: 25603 - DNA, 24 bp, Homo sapiens
caggctggaatacagtggcacgat

SEQ ID NO: 25604 - DNA, 23 bp, Homo sapiens
gctgagcgtctggatggtgtctc

SEQ ID NO: 25605 - DNA, 23 bp, Homo sapiens
gaacactcagcttcatccactcc

SEQ ID NO: 25606 - DNA, 25 bp, Homo sapiens
gcatttccaacagaccctgaggaca

SEQ ID NO: 25607 - DNA, 23 bp, Homo sapiens
gctgggattacagggcttcagaa

SEQ ID NO: 25608 - DNA, 24 bp, Homo sapiens
caggctggaatacagtggcacgat

SEQ ID NO: 25609 - DNA, 24 bp, Homo sapiens
ggagtggaaatgcctggaccctgg

SEQ ID NO: 25610 - DNA, 24 bp, Homo sapiens
acagggacgtgatgttagagaact

SEQ ID NO: 25611 - DNA, 24 bp, Homo sapiens
gcaattgtcattcagcgatgtggc

SEQ ID NO: 25612 - DNA, 25 bp, Homo sapiens
cacgcacctacttccagagaacgaa

SEQ ID NO: 25613 - DNA, 23 bp, Homo sapiens
gaagagggctcagaggacgaggg

SEQ ID NO: 25614 - DNA, 25 bp, Homo sapiens
gaacctcaggataccgttattagga

SEQ ID NO: 25615 - DNA, 23 bp, Homo sapiens
cccaggaatgaacaaggacagct

SEQ ID NO: 25616 - DNA, 23 bp, Homo sapiens
attccttccctaagttaattcag

SEQ ID NO: 25617 - DNA, 24 bp, Homo sapiens
tccttgtcttgcctttgtcgctcc

SEQ ID NO: 25618 - DNA, 23 bp, Homo sapiens
tcttccctggctgggctggcgga

SEQ ID NO: 25619 - DNA, 23 bp, Homo sapiens
tcaactgacaagcgctggggaca

SEQ ID NO: 25620 - DNA, 23 bp, Homo sapiens
tgaggaggcgatcaggagggagc

SEQ ID NO: 25621 - DNA, 23 bp, Homo sapiens
atcgctgaactgtgtgcctctgc

SEQ ID NO: 25622 - DNA, 25 bp, Homo sapiens
gccactgtcattgctgaagtttatt

SEQ ID NO: 25623 - DNA, 24 bp, Homo sapiens
tgaacgtgccagtaagtaagatgg

SEQ ID NO: 25624 - DNA, 24 bp, Homo sapiens
ttgaacgtgccagtaagtaagatg

SEQ ID NO: 25625 - DNA, 24 bp, Homo sapiens
tttgaacgtgccagtaagtaagat

SEQ ID NO: 25626 - DNA, 24 bp, Homo sapiens
attgttatcaggatttcagctctt

SEQ ID NO: 25627 - DNA, 24 bp, Homo sapiens
aattgttatcaggatttcagctct

SEQ ID NO: 25628 - DNA, 24 bp, Homo sapiens
aaattgttatcaggatttcagctc

SEQ ID NO: 25629 - DNA, 24 bp, Homo sapiens
ggcgctgacaggaccgtgtttctt

SEQ ID NO: 25630 - DNA, 24 bp, Homo sapiens
tggcgctgacaggaccgtgtttct

SEQ ID NO: 25631 - DNA, 24 bp, Homo sapiens
ttggcgctgacaggaccgtgtttc

SEQ ID NO: 25632 - DNA, 24 bp, Homo sapiens
aacaaatgaagctctgtgtccaga

SEQ ID NO: 25633 - DNA, 24 bp, Homo sapiens
aaacaaatgaagctctgtgtccag

SEQ ID NO: 25634 - DNA, 24 bp, Homo sapiens
gaaacaaatgaagctctgtgtcca

SEQ ID NO: 25635 - DNA, 24 bp, Homo sapiens
tcactttttagaaaattctgcatc

SEQ ID NO: 25636 - DNA, 24 bp, Homo sapiens
ttcactttttagaaaattctgcat

SEQ ID NO: 25637 - DNA, 24 bp, Homo sapiens
tttcactttttagaaaattctgca

SEQ ID NO: 25638 - DNA, 23 bp, Homo sapiens
gaacaggctgaggctgaagtggc

SEQ ID NO: 25639 - DNA, 24 bp, Homo sapiens
ggttgaagaggagctggactgtgc

SEQ ID NO: 25640 - DNA, 25 bp, Homo sapiens
tccaggaaatccaactcaaagaagc

SEQ ID NO: 25641 - DNA, 24 bp, Homo sapiens
ggctttgctgggtccatcacagaa

SEQ ID NO: 25642 - DNA, 25 bp, Homo sapiens
acagatatgtgatgcaagaaaccat

SEQ ID NO: 25643 - DNA, 25 bp, Homo sapiens
gatgtggctgtgaacttcacccagg

SEQ ID NO: 25644 - DNA, 24 bp, Homo sapiens
ctttttttttttttttttgagaca

SEQ ID NO: 25645 - DNA, 24 bp, Homo sapiens
tctttttttttttttttttgagac

SEQ ID NO: 25646 - DNA, 24 bp, Homo sapiens
atctttttttttttttttttgaga

SEQ ID NO: 25647 - DNA, 25 bp, Homo sapiens
attcatcagcgactacctctggagt

SEQ ID NO: 25648 - DNA, 23 bp, Homo sapiens
gagtggtagccaggagcctcgtg

SEQ ID NO: 25649 - DNA, 23 bp, Homo sapiens
cagtggcacaatctcggctcaca

SEQ ID NO: 25650 - DNA, 23 bp, Homo sapiens
tgagcagcctggaggacctggag

SEQ ID NO: 25651 - DNA, 24 bp, Homo sapiens
gctggaggacctgaagactctggc

SEQ ID NO: 25652 - DNA, 23 bp, Homo sapiens
cctggaggaacagaatcgcagcc

SEQ ID NO: 25653 - DNA, 24 bp, Homo sapiens
tggagaaggacactttgaagcggc

SEQ ID NO: 25654 - DNA, 25 bp, Homo sapiens
tctggtggctgagatggagactctg

SEQ ID NO: 25655 - DNA, 23 bp, Homo sapiens
cctggaggaacagaatcgcagcc

SEQ ID NO: 25656 - DNA, 25 bp, Homo sapiens
ttctagcttcccatcgacggtcagt

SEQ ID NO: 25657 - DNA, 23 bp, Homo sapiens
gattggtgttggcggtctggctc

SEQ ID NO: 25658 - DNA, 23 bp, Homo sapiens
ggggtaactttactgatttgggg

SEQ ID NO: 25659 - DNA, 25 bp, Homo sapiens
aacctgaccttgaacaccttggacc

SEQ ID NO: 25660 - DNA, 24 bp, Homo sapiens
ggattgccgcttagagattcttgg

SEQ ID NO: 25661 - DNA, 23 bp, Homo sapiens
ctgctgctggctgtgaagacctc

SEQ ID NO: 25662 - DNA, 25 bp, Homo sapiens
agatacgagcagagtcaggcacagt

SEQ ID NO: 25663 - DNA, 23 bp, Homo sapiens
atcttggctcaccgcaacctccg

SEQ ID NO: 25664 - DNA, 25 bp, Homo sapiens
tctcctgaccttgtgatctgcctgt

SEQ ID NO: 25665 - DNA, 23 bp, Homo sapiens
acctcactacatctgctttccac

SEQ ID NO: 25666 - DNA, 23 bp, Homo sapiens
tcccaaagcctcagagatcagta

SEQ ID NO: 25667 - DNA, 23 bp, Homo sapiens
ccgccgctgcctcctcctcaagc

SEQ ID NO: 25668 - DNA, 24 bp, Homo sapiens
cacggtccttctgtccctcatcca

SEQ ID NO: 25669 - DNA, 25 bp, Homo sapiens
aggaggatgacgaggatgaggaagg

SEQ ID NO: 25670 - DNA, 25 bp, Homo sapiens
ccttctggaccaatcctcagttccg

SEQ ID NO: 25671 - DNA, 23 bp, Homo sapiens
cgtcgtggtggatgacaggctgc

SEQ ID NO: 25672 - DNA, 23 bp, Homo sapiens
gctccacggctcctatgaggtga

SEQ ID NO: 25673 - DNA, 24 bp, Homo sapiens
ggcgaggtgctctatctgagacaa

SEQ ID NO: 25674 - DNA, 24 bp, Homo sapiens
cccttttacagaaatatttagagc

SEQ ID NO: 25675 - DNA, 24 bp, Homo sapiens
tcccttttacagaaatatttagag

SEQ ID NO: 25676 - DNA, 24 bp, Homo sapiens
tcccttttacagaaatatttagag

SEQ ID NO: 25677 - DNA, 23 bp, Homo sapiens
ggctgccatccgcttctactacg

SEQ ID NO: 25678 - DNA, 23 bp, Homo sapiens
ccgccgctgctccaactaccacg

SEQ ID NO: 25679 - DNA, 23 bp, Homo sapiens
cgctgcccactagaagcctcgtg

SEQ ID NO: 25680 - DNA, 23 bp, Homo sapiens
cggacgcagcaggacagaatctc

SEQ ID NO: 25681 - DNA, 25 bp, Homo sapiens
acgcttctgaaactggtgtaggaac

SEQ ID NO: 25682 - DNA, 23 bp, Homo sapiens
ggacgctgctgccactgtaataa

SEQ ID NO: 25683 - DNA, 24 bp, Homo sapiens
agaaccttggaatgtgaagagaca

SEQ ID NO: 25684 - DNA, 24 bp, Homo sapiens
agacctgatcacctgtctggagca

SEQ ID NO: 25685 - DNA, 23 bp, Homo sapiens
cacggtggagcagatcctggagg

SEQ ID NO: 25686 - DNA, 23 bp, Homo sapiens
cagagatgggctccaaggcaaag

SEQ ID NO: 25687 - DNA, 23 bp, Homo sapiens
gtgctgctgcccacccgcccagc

SEQ ID NO: 25688 - DNA, 23 bp, Homo sapiens
aagtgctggattacaggcgtgag

SEQ ID NO: 25689 - DNA, 23 bp, Homo sapiens
caggaggatggggtggtcagcag

SEQ ID NO: 25690 - DNA, 23 bp, Homo sapiens
ctggcaagctcactcggggactg

SEQ ID NO: 25691 - DNA, 24 bp, Homo sapiens
gatgtggtctgtctccgcaaggac

SEQ ID NO: 25692 - DNA, 23 bp, Homo sapiens
gcctgtgctatgtggagacggtg

SEQ ID NO: 25693 - DNA, 25 bp, Homo sapiens
ggtgcctggaatggaatgacaagaa

SEQ ID NO: 25694 - DNA, 24 bp, Homo sapiens
ctcctcagccttggtttctacgcc

SEQ ID NO: 25695 - DNA, 23 bp, Homo sapiens
gtatgccgacctcagcgtgatgt

SEQ ID NO: 25696 - DNA, 23 bp, Homo sapiens
atcctgctggtggtcctgctgag

SEQ ID NO: 25697 - DNA, 25 bp, Homo sapiens
gcctccagtccctcttctgctaatc

SEQ ID NO: 25698 - DNA, 24 bp, Homo sapiens
cttcagaggcaacatggcggacaa

SEQ ID NO: 25699 - DNA, 23 bp, Homo sapiens
gcagatgtcggtcaaggagcaca

SEQ ID NO: 25700 - DNA, 23 bp, Homo sapiens
cgaccagttacggaagaggcggc

SEQ ID NO: 25701 - DNA, 23 bp, Homo sapiens
gcctgactctcctgaacagccaa

SEQ ID NO: 25702 - DNA, 23 bp, Homo sapiens
atcgcaccaccgcactccagcct

SEQ ID NO: 25703 - DNA, 23 bp, Homo sapiens
gaccgatgaggagaagcgtctgc

SEQ ID NO: 25704 - DNA, 23 bp, Homo sapiens
caaccctgctgccctgtcaaacc

SEQ ID NO: 25705 - DNA, 25 bp, Homo sapiens
tctatgaggttgtctatgaggcagg

SEQ ID NO: 25706 - DNA, 24 bp, Homo sapiens
tcaaaaagctgatcatactttatc

SEQ ID NO: 25707 - DNA, 24 bp, Homo sapiens
atcaaaaagctgatcatactttat

SEQ ID NO: 25708 - DNA, 24 bp, Homo sapiens
tatcaaaaagctgatcatacttta

SEQ ID NO: 25709 - DNA, 23 bp, Homo sapiens
caccgcagccgccacctcgttat

SEQ ID NO: 25710 - DNA, 23 bp, Homo sapiens
tcagagaagagggcacgaagcga

SEQ ID NO: 25711 - DNA, 23 bp, Homo sapiens
cttgtgtcagcactgagcgaggc

SEQ ID NO: 25712 - DNA, 23 bp, Homo sapiens
gtcgtgctgtgcgtgtgctcctc

SEQ ID NO: 25713 - DNA, 23 bp, Homo sapiens
ggtttgccaccaactggaacttt

SEQ ID NO: 25714 - DNA, 25 bp, Homo sapiens
gagaagcagtctgtgaagcagcgat

SEQ ID NO: 25715 - DNA, 24 bp, Homo sapiens
tgcaattcgaggagctgaaggagg

SEQ ID NO: 25716 - DNA, 24 bp, Homo sapiens
ttgcaattcgaggagctgaaggag

SEQ ID NO: 25717 - DNA, 24 bp, Homo sapiens
tttgcaattcgaggagctgaagga

SEQ ID NO: 25718 - DNA, 24 bp, Homo sapiens
gagaacagattgctccagcctgcc

SEQ ID NO: 25719 - DNA, 24 bp, Homo sapiens
ccgctctccagggcacatccagat

SEQ ID NO: 25720 - DNA, 24 bp, Homo sapiens
aagtgctgggattacaggcgtgag

SEQ ID NO: 25721 - DNA, 24 bp, Homo sapiens
atgtctttaacgtggccctgcagc

SEQ ID NO: 25722 - DNA, 24 bp, Homo sapiens
tgcagcaggcagggtctgagtgca

SEQ ID NO: 25723 - DNA, 24 bp, Homo sapiens
ctgggcaccttcctggccatggag

SEQ ID NO: 25724 - DNA, 23 bp, Homo sapiens
cggagcagggcagtcctcggagc

SEQ ID NO: 25725 - DNA, 23 bp, Homo sapiens
cacctggaggggcgatgaggctc

SEQ ID NO: 25726 - DNA, 23 bp, Homo sapiens
cgtgcatcagcctctctggcggg

SEQ ID NO: 25727 - DNA, 24 bp, Homo sapiens
agagattctcctgcctcagcctcc

SEQ ID NO: 25728 - DNA, 23 bp, Homo sapiens
ctcaccccaacctccacctcccg

SEQ ID NO: 25729 - DNA, 23 bp, Homo sapiens
caggctggagtgcaatggcgcgg

SEQ ID NO: 25730 - DNA, 23 bp, Homo sapiens
ggtggggtgggaggggcgggaac

SEQ ID NO: 25731 - DNA, 23 bp, Homo sapiens
cacagccgccgccaccgccaccg

SEQ ID NO: 25732 - DNA, 23 bp, Homo sapiens
gcctccagggtgggcgcctttcg

SEQ ID NO: 25733 - DNA, 23 bp, Homo sapiens
cacagccgccgccaccgccaccg

SEQ ID NO: 25734 - DNA, 23 bp, Homo sapiens
ggtggggtgggaggggcgggaac

SEQ ID NO: 25735 - DNA, 23 bp, Homo sapiens
ccgcctccagggtgggcgccttt

SEQ ID NO: 25736 - DNA, 23 bp, Homo sapiens
gtgctgatgctgctgtccaagga

SEQ ID NO: 25737 - DNA, 25 bp, Homo sapiens
tgatgagcttgccttggagacacag

SEQ ID NO: 25738 - DNA, 25 bp, Homo sapiens
tccttctttgccatccacatcacgg

SEQ ID NO: 25739 - DNA, 23 bp, Homo sapiens
ggtgcctattccgccttcgtgta

SEQ ID NO: 25740 - DNA, 25 bp, Homo sapiens
tccttctttgccatccacatcacgg

SEQ ID NO: 25741 - DNA, 23 bp, Homo sapiens
tgtgctgatgctgctgtccaagg

SEQ ID NO: 25742 - DNA, 24 bp, Homo sapiens
gattttacaaggtgtatttttaca

SEQ ID NO: 25743 - DNA, 24 bp, Homo sapiens
agattttacaaggtgtatttttac

SEQ ID NO: 25744 - DNA, 24 bp, Homo sapiens
cagattttacaaggtgtattttta

SEQ ID NO: 25745 - DNA, 24 bp, Homo sapiens
aggacctgctggtcaggaatctgc

SEQ ID NO: 25746 - DNA, 24 bp, Homo sapiens
aaggacctgctggtcaggaatctg

SEQ ID NO: 25747 - DNA, 24 bp, Homo sapiens
caaggacctgctggtcaggaatct

SEQ ID NO: 25748 - DNA, 24 bp, Homo sapiens
ttcctgtcactgctcttctgctgg

SEQ ID NO: 25749 - DNA, 23 bp, Homo sapiens
tgggcaaggaaggcaggctcttt

SEQ ID NO: 25750 - DNA, 25 bp, Homo sapiens
gccaatctgcgacacaatctcaaca

SEQ ID NO: 25751 - DNA, 23 bp, Homo sapiens
ggactacgtgtaccgccaggagg

SEQ ID NO: 25752 - DNA, 25 bp, Homo sapiens
gaaatgagcaatgtggtgagggagc

SEQ ID NO: 25753 - DNA, 23 bp, Homo sapiens
cattccgctgctgctggtggtgc

SEQ ID NO: 25754 - DNA, 25 bp, Homo sapiens
gaaatgagcaatgtggtgagggagc

SEQ ID NO: 25755 - DNA, 23 bp, Homo sapiens
cattccgctgctgctggtggtgc

SEQ ID NO: 25756 - DNA, 23 bp, Homo sapiens
gacaccatccgccaccactcctt

SEQ ID NO: 25757 - DNA, 23 bp, Homo sapiens
cattccgctgctgctggtggtgc

SEQ ID NO: 25758 - DNA, 23 bp, Homo sapiens
gacaccatccgccaccactcctt

SEQ ID NO: 25759 - DNA, 25 bp, Homo sapiens
acacctcctcagagacagtgatgga

SEQ ID NO: 25760 - DNA, 25 bp, Homo sapiens
ccagaaggtgattgacattgaaggc

SEQ ID NO: 25761 - DNA, 25 bp, Homo sapiens
tggtgtctgttaattgtgaaagcct

SEQ ID NO: 25762 - DNA, 25 bp, Homo sapiens
agcagttccatctcctattgattgt

SEQ ID NO: 25763 - DNA, 24 bp, Homo sapiens
gtgtcatggaggaattacaaatat

SEQ ID NO: 25764 - DNA, 24 bp, Homo sapiens
ggtgtcatggaggaattacaaata

SEQ ID NO: 25765 - DNA, 24 bp, Homo sapiens
tggtgtcatggaggaattacaaat

SEQ ID NO: 25766 - DNA, 24 bp, Homo sapiens
acccacaagtctctgccaggaatg

SEQ ID NO: 25767 - DNA, 24 bp, Homo sapiens
ctccgtgctcttgtgctatgccag

SEQ ID NO: 25768 - DNA, 24 bp, Homo sapiens
gaggatgaggctgtcactactaca

SEQ ID NO: 25769 - DNA, 24 bp, Homo sapiens
ctctagtgcagggattatcgtgat

SEQ ID NO: 25770 - DNA, 24 bp, Homo sapiens
actctagtgcagggattatcgtga

SEQ ID NO: 25771 - DNA, 24 bp, Homo sapiens
aactctagtgcagggattatcgtg

SEQ ID NO: 25772 - DNA, 25 bp, Homo sapiens
tcacaccattctcctgcctaagcct

SEQ ID NO: 25773 - DNA, 25 bp, Homo sapiens
tggaaggtaaggctacagtgagtca

SEQ ID NO: 25774 - DNA, 24 bp, Homo sapiens
ttgagatggagtcttgttctggcg

SEQ ID NO: 25775 - DNA, 24 bp, Homo sapiens
cctggactcacacttcctcctgcc

SEQ ID NO: 25776 - DNA, 23 bp, Homo sapiens
caccaccgctgccaccacttcca

SEQ ID NO: 25777 - DNA, 23 bp, Homo sapiens
ggatgccagcctacaaccgaagg

SEQ ID NO: 25778 - DNA, 24 bp, Homo sapiens
tttcttttcagaaaaattgcttcg

SEQ ID NO: 25779 - DNA, 24 bp, Homo sapiens
ttttcttttcagaaaaattgcttc

SEQ ID NO: 25780 - DNA, 24 bp, Homo sapiens
cttttcttttcagaaaaattgctt

SEQ ID NO: 25781 - DNA, 24 bp, Homo sapiens
tgtctctgcggaacaataacatcg

SEQ ID NO: 25782 - DNA, 23 bp, Homo sapiens
aaccgttccctgctctggctgtc

SEQ ID NO: 25783 - DNA, 23 bp, Homo sapiens
ccacaaccgcatccaggacaagg

SEQ ID NO: 25784 - DNA, 24 bp, Homo sapiens
gctgagattacaggcgtgacccac

SEQ ID NO: 25785 - DNA, 24 bp, Homo sapiens
gcccactttgaagtcctaaagaaa

SEQ ID NO: 25786 - DNA, 24 bp, Homo sapiens
ttattctatgcatgttggaggatt

SEQ ID NO: 25787 - DNA, 24 bp, Homo sapiens
cccttctgtgattaccactccagc

SEQ ID NO: 25788 - DNA, 24 bp, Homo sapiens
cgagtgaggcggagacccaggcgg

SEQ ID NO: 25789 - DNA, 24 bp, Homo sapiens
ctgctgcccttgtccctgccgccg

SEQ ID NO: 25790 - DNA, 24 bp, Homo sapiens
aagaagagttggtggctgctgtag

SEQ ID NO: 25791 - DNA, 24 bp, Homo sapiens
agcatgacttcggcaacttcacct

SEQ ID NO: 25792 - DNA, 24 bp, Homo sapiens
gcctctgtagagcaagccactcag

SEQ ID NO: 25793 - DNA, 24 bp, Homo sapiens
tctgtgattaccactccagctgct

SEQ ID NO: 25794 - DNA, 24 bp, Homo sapiens
cttgtccctgccgccgcctctcca

SEQ ID NO: 25795 - DNA, 24 bp, Homo sapiens
cacctcggccagaggcggctgcag

SEQ ID NO: 25796 - DNA, 24 bp, Homo sapiens
ctgtagagcaagccactcagaatt

SEQ ID NO: 25797 - DNA, 24 bp, Homo sapiens
ggtgaacagatcgctaaggagagt

SEQ ID NO: 25798 - DNA, 24 bp, Homo sapiens
agagttggtggctgctgtagagga

SEQ ID NO: 25799 - DNA, 24 bp, Homo sapiens
ggtgacacgcttactcatcctggc

SEQ ID NO: 25800 - DNA, 24 bp, Homo sapiens
caaacaaggtgagacgatgcggat

SEQ ID NO: 25801 - DNA, 24 bp, Homo sapiens
agagttggtggctgctgtagagga

SEQ ID NO: 25802 - DNA, 25 bp, Homo sapiens
caatctcagctcactgcaacctctg

SEQ ID NO: 25803 - DNA, 25 bp, Homo sapiens
cgtcgtcttcttcatccagcacttc

SEQ ID NO: 25804 - DNA, 24 bp, Homo sapiens
ctacaacaacgaccagtggacgct

SEQ ID NO: 25805 - DNA, 23 bp, Homo sapiens
ctgagggctggagcattggcaac

SEQ ID NO: 25806 - DNA, 23 bp, Homo sapiens
cgtggctcttcgcatttgtcacc

SEQ ID NO: 25807 - DNA, 25 bp, Homo sapiens
ctcgcagtcacgctggtcaagtatt

SEQ ID NO: 25808 - DNA, 23 bp, Homo sapiens
ctgagggctggagcattggcaac

SEQ ID NO: 25809 - DNA, 24 bp, Homo sapiens
agcaaaaagaggtggaaagatttc

SEQ ID NO: 25810 - DNA, 24 bp, Homo sapiens
gagcaaaaagaggtggaaagattt

SEQ ID NO: 25811 - DNA, 24 bp, Homo sapiens
tgagcaaaaagaggtggaaagatt

SEQ ID NO: 25812 - DNA, 23 bp, Homo sapiens
cgagacaaacacggtcctcaggg

SEQ ID NO: 25813 - DNA, 23 bp, Homo sapiens
gtctgtggtggctgtgtgtggca

SEQ ID NO: 25814 - DNA, 23 bp, Homo sapiens
atgtggatggcctggtgtgtggc

SEQ ID NO: 25815 - DNA, 24 bp, Homo sapiens
cttgctgtggtggctgggatgctc

SEQ ID NO: 25816 - DNA, 24 bp, Homo sapiens
tgttctctgtgttaaaccaatcag

SEQ ID NO: 25817 - DNA, 24 bp, Homo sapiens
ccatgattttttgaatctagactg

SEQ ID NO: 25818 - DNA, 24 bp, Homo sapiens
aacaaatcagggtgaatctaaaca

SEQ ID NO: 25819 - DNA, 24 bp, Homo sapiens
caacaaatcagggtgaatctaaac

SEQ ID NO: 25820 - DNA, 24 bp, Homo sapiens
tcaacaaatcagggtgaatctaaa

SEQ ID NO: 25821 - DNA, 24 bp, Homo sapiens
actgttttcagagcttggaaaaac

SEQ ID NO: 25822 - DNA, 24 bp, Homo sapiens
tactgttttcagagcttggaaaaa

SEQ ID NO: 25823 - DNA, 24 bp, Homo sapiens
atactgttttcagagcttggaaaa

SEQ ID NO: 25824 - DNA, 23 bp, Homo sapiens
ggaccctgggcaaaggcaacttc

SEQ ID NO: 25825 - DNA, 25 bp, Homo sapiens
atggttatcatgtcggagttcagcg

SEQ ID NO: 25826 - DNA, 23 bp, Homo sapiens
ggagcagtaggcacccgagcagc

SEQ ID NO: 25827 - DNA, 24 bp, Homo sapiens
cttttgttcagagaatttggatgg

SEQ ID NO: 25828 - DNA, 24 bp, Homo sapiens
ccttttgttcagagaatttggatg

SEQ ID NO: 25829 - DNA, 24 bp, Homo sapiens
tccttttgttcagagaatttggat

SEQ ID NO: 25830 - DNA, 24 bp, Homo sapiens
gatccgagactggcagcatgagca

SEQ ID NO: 25831 - DNA, 24 bp, Homo sapiens
acagtttgaaaggctgacccgaga

SEQ ID NO: 25832 - DNA, 24 bp, Homo sapiens
aaccacctctgccatcctcgcctc

SEQ ID NO: 25833 - DNA, 24 bp, Homo sapiens
gtgaagaccagaaaaaacttacat

SEQ ID NO: 25834 - DNA, 24 bp, Homo sapiens
agtgaagaccagaaaaaacttaca

SEQ ID NO: 25835 - DNA, 24 bp, Homo sapiens
aagtgaagaccagaaaaaacttac

SEQ ID NO: 25836 - DNA, 24 bp, Homo sapiens
tcgggaacttagaggacttgggct

SEQ ID NO: 25837 - DNA, 24 bp, Homo sapiens
gccttccgtcagttccaattcaag

SEQ ID NO: 25838 - DNA, 24 bp, Homo sapiens
ggagtgggtgatgagacaggcgtt

SEQ ID NO: 25839 - DNA, 24 bp, Homo sapiens
gcagtttgcaggttcaccagacac

SEQ ID NO: 25840 - DNA, 24 bp, Homo sapiens
ggcagtttgcaggttcaccagaca

SEQ ID NO: 25841 - DNA, 24 bp, Homo sapiens
gggcagtttgcaggttcaccagac

SEQ ID NO: 25842 - DNA, 23 bp, Homo sapiens
cctccaagaagcagttagcagcc

SEQ ID NO: 25843 - DNA, 25 bp, Homo sapiens
acaagctcagccatgtgcagagatg

SEQ ID NO: 25844 - DNA, 23 bp, Homo sapiens
gaggtggctgctgaggccttgaa

SEQ ID NO: 25845 - DNA, 25 bp, Homo sapiens
cctgattctctgacctacctctgcg

SEQ ID NO: 25846 - DNA, 25 bp, Homo sapiens
cgaatcctgacctcaagtgatccgc

SEQ ID NO: 25847 - DNA, 23 bp, Homo sapiens
gagccagcacacccagccagttt

SEQ ID NO: 25848 - DNA, 24 bp, Homo sapiens
gtgtgggcccgatgttcttggagg

SEQ ID NO: 25849 - DNA, 24 bp, Homo sapiens
tgtgtgggcccgatgttcttggag

SEQ ID NO: 25850 - DNA, 24 bp, Homo sapiens
gtgtgtgggcccgatgttcttgga

SEQ ID NO: 25851 - DNA, 24 bp, Homo sapiens
cttctaaatctgtaagtagaaatt

SEQ ID NO: 25852 - DNA, 24 bp, Homo sapiens
ccttctaaatctgtaagtagaaat

SEQ ID NO: 25853 - DNA, 24 bp, Homo sapiens
accttctaaatctgtaagtagaaa

SEQ ID NO: 25854 - DNA, 23 bp, Homo sapiens
ctcctgccgctgcgcgtctagtc

SEQ ID NO: 25855 - DNA, 23 bp, Homo sapiens
cactggccgcctccctcctctgg

SEQ ID NO: 25856 - DNA, 23 bp, Homo sapiens
ccggcctgatgagggaagcaggg

SEQ ID NO: 25857 - DNA, 23 bp, Homo sapiens
ttcaggaggcagaggtcggtgtc

SEQ ID NO: 25858 - DNA, 24 bp, Homo sapiens
tgtctgcggatcctttttccagcc

SEQ ID NO: 25859 - DNA, 23 bp, Homo sapiens
ccggccagccaagcagcagtgac

SEQ ID NO: 25860 - DNA, 24 bp, Homo sapiens
aatatggacaggaatctgaatttc

SEQ ID NO: 25861 - DNA, 24 bp, Homo sapiens
aaatatggacaggaatctgaattt

SEQ ID NO: 25862 - DNA, 24 bp, Homo sapiens
caaatatggacaggaatctgaatt

SEQ ID NO: 25863 - DNA, 25 bp, Homo sapiens
tcttgctgctgattggtgtggtctg

SEQ ID NO: 25864 - DNA, 23 bp, Homo sapiens
cctcatggtcttcctgctgctga

SEQ ID NO: 25865 - DNA, 25 bp, Homo sapiens
ggacgagtgaagacagagcacaagg

SEQ ID NO: 25866 - DNA, 24 bp, Homo sapiens
gtgctgtgctccgtggtcctattc

SEQ ID NO: 25867 - DNA, 23 bp, Homo sapiens
caggaggtggaggagagcagccg

SEQ ID NO: 25868 - DNA, 23 bp, Homo sapiens
tgaggacactggctgaagggttc

SEQ ID NO: 25869 - DNA, 23 bp, Homo sapiens
ccgtggcacagcaattctccctg

SEQ ID NO: 25870 - DNA, 25 bp, Homo sapiens
tggatggtgttggtgtgagcattgg

SEQ ID NO: 25871 - DNA, 25 bp, Homo sapiens
accttgaatgctacagtggtagagc

SEQ ID NO: 25872 - DNA, 24 bp, Homo sapiens
gctcctgctgggtaaggccctgct

SEQ ID NO: 25873 - DNA, 24 bp, Homo sapiens
ggctcctgctgggtaaggccctgc

SEQ ID NO: 25874 - DNA, 24 bp, Homo sapiens
tggctcctgctgggtaaggccctg

SEQ ID NO: 25875 - DNA, 23 bp, Homo sapiens
cagatgtaagcgatctggttccc

SEQ ID NO: 25876 - DNA, 23 bp, Homo sapiens
gaccacggctcacggcagcctca

SEQ ID NO: 25877 - DNA, 25 bp, Homo sapiens
cctctgagcctcttgaatacaactg

SEQ ID NO: 25878 - DNA, 23 bp, Homo sapiens
gcgattctcctgcttcagtctcc

SEQ ID NO: 25879 - DNA, 23 bp, Homo sapiens
atctctggtcaccgcaacctccg

SEQ ID NO: 25880 - DNA, 24 bp, Homo sapiens
taaagcagagagttttaatttttc

SEQ ID NO: 25881 - DNA, 24 bp, Homo sapiens
ttaaagcagagagttttaattttt

SEQ ID NO: 25882 - DNA, 24 bp, Homo sapiens
tttaaagcagagagttttaatttt

SEQ ID NO: 25883 - DNA, 23 bp, Homo sapiens
caggttggagtacagtggcatga

SEQ ID NO: 25884 - DNA, 25 bp, Homo sapiens
ttcactacaacctctacctcttggg

SEQ ID NO: 25885 - DNA, 23 bp, Homo sapiens
cgatcctcccacctcggtcttct

SEQ ID NO: 25886 - DNA, 25 bp, Homo sapiens
gcgtcattcacttcatggagacaca

SEQ ID NO: 25887 - DNA, 23 bp, Homo sapiens
gcaccacttccgcctccacttga

SEQ ID NO: 25888 - DNA, 25 bp, Homo sapiens
ggctggcacctacattaaagagttt

SEQ ID NO: 25889 - DNA, 24 bp, Homo sapiens
atgaacagatagtaaacattatac

SEQ ID NO: 25890 - DNA, 24 bp, Homo sapiens
gatgaacagatagtaaacattata

SEQ ID NO: 25891 - DNA, 24 bp, Homo sapiens
tgatgaacagatagtaaacattat

SEQ ID NO: 25892 - DNA, 24 bp, Homo sapiens
tcgaaaaacagagtgcacagttga

SEQ ID NO: 25893 - DNA, 24 bp, Homo sapiens
atcgaaaaacagagtgcacagttg

SEQ ID NO: 25894 - DNA, 24 bp, Homo sapiens
catcgaaaaacagagtgcacagtt

SEQ ID NO: 25895 - DNA, 23 bp, Homo sapiens
gctctggagacgagtcagcggcg

SEQ ID NO: 25896 - DNA, 23 bp, Homo sapiens
cgaaggtgcggcggcggagggga

SEQ ID NO: 25897 - DNA, 23 bp, Homo sapiens
cacctcagcagcccccaccacgg

SEQ ID NO: 25898 - DNA, 25 bp, Homo sapiens
agaaagagtacattggaagggcagc

SEQ ID NO: 25899 - DNA, 23 bp, Homo sapiens
ctcctggagctgctgctgcttct

SEQ ID NO: 25900 - DNA, 25 bp, Homo sapiens
ttctgatattaaatttgtggcagcc

SEQ ID NO: 25901 - DNA, 24 bp, Homo sapiens
agcaggtacagtgagcaggagtcc

SEQ ID NO: 25902 - DNA, 24 bp, Homo sapiens
ccgactccaggattctaccacgct

SEQ ID NO: 25903 - DNA, 24 bp, Homo sapiens
aggatgatggagccagcaggagag

SEQ ID NO: 25904 - DNA, 25 bp, Homo sapiens
tgtaagatcactgcctctccaactg

SEQ ID NO: 25905 - DNA, 23 bp, Homo sapiens
gcttgctccaggctaccagtgtc

SEQ ID NO: 25906 - DNA, 25 bp, Homo sapiens
acaagattgctaccatgtactcaca

SEQ ID NO: 25907 - DNA, 24 bp, Homo sapiens
cagcagcacaggcagtacatgcca

SEQ ID NO: 25908 - DNA, 24 bp, Homo sapiens
acagcagcacaggcagtacatgcc

SEQ ID NO: 25909 - DNA, 24 bp, Homo sapiens
aacagcagcacaggcagtacatgc

SEQ ID NO: 25910 - DNA, 24 bp, Homo sapiens
gggcaagagttggacagttcaggg

SEQ ID NO: 25911 - DNA, 23 bp, Homo sapiens
ctgctaccgccaccgccaccgcc

SEQ ID NO: 25912 - DNA, 23 bp, Homo sapiens
cagcagatcgcgggagaacgtct

SEQ ID NO: 25913 - DNA, 25 bp, Homo sapiens
ctactacccttcctgctcttgtgcg

SEQ ID NO: 25914 - DNA, 23 bp, Homo sapiens
cagcaacagcagcacaggcagta

SEQ ID NO: 25915 - DNA, 23 bp, Homo sapiens
gcattccaacggcaaatcccacc

SEQ ID NO: 25916 - DNA, 24 bp, Homo sapiens
tctttttacagataattcttctat

SEQ ID NO: 25917 - DNA, 24 bp, Homo sapiens
atctttttacagataattcttcta

SEQ ID NO: 25918 - DNA, 24 bp, Homo sapiens
aatctttttacagataattcttct

SEQ ID NO: 25919 - DNA, 25 bp, Homo sapiens
ctggaggctcttcaggagaatctgt

SEQ ID NO: 25920 - DNA, 23 bp, Homo sapiens
ttgtcaattcctgatggctgctg

SEQ ID NO: 25921 - DNA, 23 bp, Homo sapiens
cttggcatgtggctgcatcactc

SEQ ID NO: 25922 - DNA, 25 bp, Homo sapiens
aagagtctgatagtgaagaactgga

SEQ ID NO: 25923 - DNA, 23 bp, Homo sapiens
gaacaagaaccaggagggcaccg

SEQ ID NO: 25924 - DNA, 23 bp, Homo sapiens
ttcttcggtcccttacgccctga

SEQ ID NO: 25925 - DNA, 24 bp, Homo sapiens
atggaaacatattaaaacctcttc

SEQ ID NO: 25926 - DNA, 24 bp, Homo sapiens
catggaaacatattaaaacctctt

SEQ ID NO: 25927 - DNA, 24 bp, Homo sapiens
gcatggaaacatattaaaacctct

SEQ ID NO: 25928 - DNA, 24 bp, Homo sapiens
attaaaaacagctggggagaaaac

SEQ ID NO: 25929 - DNA, 24 bp, Homo sapiens
aattaaaaacagctggggagaaaa

SEQ ID NO: 25930 - DNA, 24 bp, Homo sapiens
taattaaaaacagctggggagaaa

SEQ ID NO: 25931 - DNA, 25 bp, Homo sapiens
gtgactggctaacaagacgcaatgg

SEQ ID NO: 25932 - DNA, 25 bp, Homo sapiens
ggtgaccaaggacagtgtagcagat

SEQ ID NO: 25933 - DNA, 24 bp, Homo sapiens
ccagagcagcaacaccaaccagat

SEQ ID NO: 25934 - DNA, 25 bp, Homo sapiens
cagttcaacgagaagtatggtgtcc

SEQ ID NO: 25935 - DNA, 23 bp, Homo sapiens
gccttgctgtccgtcctcctcta

SEQ ID NO: 25936 - DNA, 23 bp, Homo sapiens
ctggagtggtgcgtggcggtgta

SEQ ID NO: 25937 - DNA, 25 bp, Homo sapiens
gtgccagcgacgaactctcataagg

SEQ ID NO: 25938 - DNA, 23 bp, Homo sapiens
cgattctcctgcctcagcctccg

SEQ ID NO: 25939 - DNA, 25 bp, Homo sapiens
tgagcattctcttcatggcactagc

SEQ ID NO: 25940 - DNA, 24 bp, Homo sapiens
tctctttctaggttttgaaacatg

SEQ ID NO: 25941 - DNA, 24 bp, Homo sapiens
ttctctttctaggttttgaaacat

SEQ ID NO: 25942 - DNA, 24 bp, Homo sapiens
tttctctttctaggttttgaaaca

SEQ ID NO: 25943 - DNA, 24 bp, Homo sapiens
ttgtttttcagaatactgagaata

SEQ ID NO: 25944 - DNA, 24 bp, Homo sapiens
attgtttttcagaatactgagaat

SEQ ID NO: 25945 - DNA, 24 bp, Homo sapiens
tattgtttttcagaatactgagaa

SEQ ID NO: 25946 - DNA, 24 bp, Homo sapiens
tatatgatactgtatgtcacaact

SEQ ID NO: 25947 - DNA, 24 bp, Homo sapiens
gtatatgatactgtatgtcacaac

SEQ ID NO: 25948 - DNA, 24 bp, Homo sapiens
agtatatgatactgtatgtcacaa

SEQ ID NO: 25949 - DNA, 24 bp, Homo sapiens
aagtagaaattgtatgtatatagt

SEQ ID NO: 25950 - DNA, 24 bp, Homo sapiens
gaagtagaaattgtatgtatatag

SEQ ID NO: 25951 - DNA, 24 bp, Homo sapiens
ggaagtagaaattgtatgtatata

SEQ ID NO: 25952 - DNA, 24 bp, Homo sapiens
gggacatgcaggtcaccaccaaat

SEQ ID NO: 25953 - DNA, 24 bp, Homo sapiens
ggggacatgcaggtcaccaccaaa

SEQ ID NO: 25954 - DNA, 24 bp, Homo sapiens
cggggacatgcaggtcaccaccaa

SEQ ID NO: 25955 - DNA, 24 bp, Homo sapiens
agcatcctccagtgtcagcatcct

SEQ ID NO: 25956 - DNA, 25 bp, Homo sapiens
tgctggcgacctacacttggataga

SEQ ID NO: 25957 - DNA, 23 bp, Homo sapiens
gtaacagccgccgccaccgaatg

SEQ ID NO: 25958 - DNA, 25 bp, Homo sapiens
ttagcaatcgacgagcaccattagg

SEQ ID NO: 25959 - DNA, 25 bp, Homo sapiens
tcacgatcaagcaccaggattacca

SEQ ID NO: 25960 - DNA, 25 bp, Homo sapiens
tcaatacgacatttgggacagcagt

SEQ ID NO: 25961 - DNA, 24 bp, Homo sapiens
cctgtgtgacaaagatgggaacgc

SEQ ID NO: 25962 - DNA, 24 bp, Homo sapiens
aagagagcaggtggtttcatcagt

SEQ ID NO: 25963 - DNA, 24 bp, Homo sapiens
cccagacccagacatcctgacctt

SEQ ID NO: 25964 - DNA, 24 bp, Homo sapiens
ctcaataaatagtaatcagctctg

SEQ ID NO: 25965 - DNA, 24 bp, Homo sapiens
actcaataaatagtaatcagctct

SEQ ID NO: 25966 - DNA, 24 bp, Homo sapiens
cactcaataaatagtaatcagctc

SEQ ID NO: 25967 - DNA, 25 bp, Homo sapiens
aaagtgaagccagcaagagggtgaa

SEQ ID NO: 25968 - DNA, 25 bp, Homo sapiens
gtcaggacttcagatgtctcttcca

SEQ ID NO: 25969 - DNA, 25 bp, Homo sapiens
ctcagccagtgtaatagccgtccaa

SEQ ID NO: 25970 - DNA, 24 bp, Homo sapiens
tgctggtaacaatcgcttagtgcc

SEQ ID NO: 25971 - DNA, 25 bp, Homo sapiens
tgctgcgaaactgcttcagaaacaa

SEQ ID NO: 25972 - DNA, 25 bp, Homo sapiens
ccgaaggtggagaattgattgctaa

SEQ ID NO: 25973 - DNA, 25 bp, Homo sapiens
cggaacctgctagaccttgatacct

SEQ ID NO: 25974 - DNA, 23 bp, Homo sapiens
tcgcccgaccagccatgtctctc

SEQ ID NO: 25975 - DNA, 23 bp, Homo sapiens
cagccctggtctcgcagcctcct

SEQ ID NO: 25976 - DNA, 24 bp, Homo sapiens
ttttcttctaggaaagtcttaata

SEQ ID NO: 25977 - DNA, 24 bp, Homo sapiens
tttttcttctaggaaagtcttaat

SEQ ID NO: 25978 - DNA, 24 bp, Homo sapiens
gtttttcttctaggaaagtcttaa

SEQ ID NO: 25979 - DNA, 24 bp, Homo sapiens
ttttcttttagatgcaagtaaaac

SEQ ID NO: 25980 - DNA, 24 bp, Homo sapiens
gttttcttttagatgcaagtaaaa

SEQ ID NO: 25981 - DNA, 24 bp, Homo sapiens
tgttttcttttagatgcaagtaaa

SEQ ID NO: 25982 - DNA, 24 bp, Homo sapiens
ccctgccccaccactcgcccatca

SEQ ID NO: 25983 - DNA, 24 bp, Homo sapiens
gccctgccccaccactcgcccatc

SEQ ID NO: 25984 - DNA, 24 bp, Homo sapiens
tgccctgccccaccactcgcccat

SEQ ID NO: 25985 - DNA, 25 bp, Homo sapiens
gcccagatgtggaaagtggtgaatc

SEQ ID NO: 25986 - DNA, 24 bp, Homo sapiens
acggaggagatcgagtggctgaag

SEQ ID NO: 25987 - DNA, 25 bp, Homo sapiens
tcccattcagcaccttccagtttct

SEQ ID NO: 25988 - DNA, 24 bp, Homo sapiens
ctgttctctggagcggtagttgtt

SEQ ID NO: 25989 - DNA, 24 bp, Homo sapiens
ctcaccgaagtgtatgtcaccacc

SEQ ID NO: 25990 - DNA, 24 bp, Homo sapiens
gcagaggcaatgaattatgaaggc

SEQ ID NO: 25991 - DNA, 24 bp, Homo sapiens
ttatttttcagaaaataaccaatt

SEQ ID NO: 25992 - DNA, 24 bp, Homo sapiens
attatttttcagaaaataaccaat

SEQ ID NO: 25993 - DNA, 24 bp, Homo sapiens
aattatttttcagaaaataaccaa

SEQ ID NO: 25994 - DNA, 23 bp, Homo sapiens
aacgactcgaacacggtgcagct

SEQ ID NO: 25995 - DNA, 23 bp, Homo sapiens
gcagaagaggttggtgccaacga

SEQ ID NO: 25996 - DNA, 23 bp, Homo sapiens
gaccctgagcccctgcagccctg

SEQ ID NO: 25997 - DNA, 24 bp, Homo sapiens
cacctctaccttcgctctcctgct

SEQ ID NO: 25998 - DNA, 25 bp, Homo sapiens
gctcctcctttgccttctgctatca

SEQ ID NO: 25999 - DNA, 24 bp, Homo sapiens
tggagggactatacaagggcatat

SEQ ID NO: 26000 - DNA, 25 bp, Homo sapiens
cagcatttggaaaggataagaaaga

SEQ ID NO: 26001 - DNA, 25 bp, Homo sapiens
ttagcaatgaaagaggtcaatttac

SEQ ID NO: 26002 - DNA, 25 bp, Homo sapiens
cagcagcgtaaggaatattgtttct

SEQ ID NO: 26003 - DNA, 24 bp, Homo sapiens
cacctctaccttcgctctcctgct

SEQ ID NO: 26004 - DNA, 23 bp, Homo sapiens
gcaagaacggattcatacactct

SEQ ID NO: 26005 - DNA, 25 bp, Homo sapiens
gctcctcctttgccttctgctatca

SEQ ID NO: 26006 - DNA, 24 bp, Homo sapiens
aggccagcacggccaccaccacct

SEQ ID NO: 26007 - DNA, 24 bp, Homo sapiens
aaggccagcacggccaccaccacc

SEQ ID NO: 26008 - DNA, 24 bp, Homo sapiens
aaaggccagcacggccaccaccac

SEQ ID NO: 26009 - DNA, 24 bp, Homo sapiens
tagaacctcaggctcttaatgatg

SEQ ID NO: 26010 - DNA, 24 bp, Homo sapiens
atagaacctcaggctcttaatgat

SEQ ID NO: 26011 - DNA, 24 bp, Homo sapiens
catagaacctcaggctcttaatga

SEQ ID NO: 26012 - DNA, 24 bp, Homo sapiens
ctggaggtgctgttgctggagaag

SEQ ID NO: 26013 - DNA, 23 bp, Homo sapiens
catctccaacagcgacctgagcg

SEQ ID NO: 26014 - DNA, 24 bp, Homo sapiens
gcaagtccgtatcactgaggctgt

SEQ ID NO: 26015 - DNA, 24 bp, Homo sapiens
ctggaggtgatttgggtggcattc

SEQ ID NO: 26016 - DNA, 23 bp, Homo sapiens
aaagaacagtgtgtcatgaagac

SEQ ID NO: 26017 - DNA, 23 bp, Homo sapiens
acttggctcgtctgtgggtctga

SEQ ID NO: 26018 - DNA, 23 bp, Homo sapiens
ctcacgcccgctcctctcctgtt

SEQ ID NO: 26019 - DNA, 23 bp, Homo sapiens
gaacgcctctggtcacagctcag

SEQ ID NO: 26020 - DNA, 24 bp, Homo sapiens
gctccacttactgagatcctgctt

SEQ ID NO: 26021 - DNA, 24 bp, Homo sapiens
ttctgcttccttctccttcttgga

SEQ ID NO: 26022 - DNA, 24 bp, Homo sapiens
ctctctgcaacctctgcctcctgg

SEQ ID NO: 26023 - DNA, 25 bp, Homo sapiens
ggagaagacactggcagagttcacc

SEQ ID NO: 26024 - DNA, 23 bp, Homo sapiens
caagccacgctcagaagcctgtt

SEQ ID NO: 26025 - DNA, 25 bp, Homo sapiens
gtgctcctcatgctgtcgttcttca

SEQ ID NO: 26026 - DNA, 25 bp, Homo sapiens
ttcttacctgaaggaatggctctgg

SEQ ID NO: 26027 - DNA, 25 bp, Homo sapiens
tctttatgtgggcttggtactggca

SEQ ID NO: 26028 - DNA, 24 bp, Homo sapiens
ctgctggcttctcctgtgctctac

SEQ ID NO: 26029 - DNA, 24 bp, Homo sapiens
attgtaataacgtaagtagatgaa

SEQ ID NO: 26030 - DNA, 24 bp, Homo sapiens
tattgtaataacgtaagtagatga

SEQ ID NO: 26031 - DNA, 24 bp, Homo sapiens
ttattgtaataacgtaagtagatg

SEQ ID NO: 26032 - DNA, 24 bp, Homo sapiens
attatttacaggtcagaaattgtg

SEQ ID NO: 26033 - DNA, 24 bp, Homo sapiens
tattatttacaggtcagaaattgt

SEQ ID NO: 26034 - DNA, 24 bp, Homo sapiens
gtattatttacaggtcagaaattg

SEQ ID NO: 26035 - DNA, 24 bp, Homo sapiens
ttcacaccattgtcctgcctcagc

SEQ ID NO: 26036 - DNA, 24 bp, Homo sapiens
ttgaggcggagtggagtgcagtgg

SEQ ID NO: 26037 - DNA, 24 bp, Homo sapiens
gttctgatatgattttaggattgc

SEQ ID NO: 26038 - DNA, 24 bp, Homo sapiens
ttctcttccagaaaatgagaaaac

SEQ ID NO: 26039 - DNA, 24 bp, Homo sapiens
gttctcttccagaaaatgagaaaa

SEQ ID NO: 26040 - DNA, 24 bp, Homo sapiens
tgttctcttccagaaaatgagaaa

SEQ ID NO: 26041 - DNA, 24 bp, Homo sapiens
aaccgcccaagaagcatgttgtgg

SEQ ID NO: 26042 - DNA, 24 bp, Homo sapiens
aaaccgcccaagaagcatgttgtg

SEQ ID NO: 26043 - DNA, 24 bp, Homo sapiens
gaaaccgcccaagaagcatgttgt

SEQ ID NO: 26044 - DNA, 23 bp, Homo sapiens
ccgaagaagacttggacgatgcc

SEQ ID NO: 26045 - DNA, 25 bp, Homo sapiens
caacacagacaggacagacaggacc

SEQ ID NO: 26046 - DNA, 25 bp, Homo sapiens
aaagtctgaaaccgcccaagaagca

SEQ ID NO: 26047 - DNA, 25 bp, Homo sapiens
cgaagatgacgatgaggatgacacc

SEQ ID NO: 26048 - DNA, 23 bp, Homo sapiens
ggagtcggtgaccagtgatggct

SEQ ID NO: 26049 - DNA, 23 bp, Homo sapiens
cgagaacaactgaggctggtggg

SEQ ID NO: 26050 - DNA, 23 bp, Homo sapiens
gccttcgcaagtctgatgttcca

SEQ ID NO: 26051 - DNA, 23 bp, Homo sapiens
agtgcctgttggtgtggacggag

SEQ ID NO: 26052 - DNA, 23 bp, Homo sapiens
cagagcctggacgacctcacctg

SEQ ID NO: 26053 - DNA, 24 bp, Homo sapiens
aaatgtattatggatttgcttcct

SEQ ID NO: 26054 - DNA, 24 bp, Homo sapiens
gaaatgtattatggatttgcttcc

SEQ ID NO: 26055 - DNA, 24 bp, Homo sapiens
agaaatgtattatggatttgcttc

SEQ ID NO: 26056 - DNA, 24 bp, Homo sapiens
gaaaaagaaaggtactaccaccac

SEQ ID NO: 26057 - DNA, 24 bp, Homo sapiens
tgaaaaagaaaggtactaccacca

SEQ ID NO: 26058 - DNA, 24 bp, Homo sapiens
atgaaaaagaaaggtactaccacc

SEQ ID NO: 26059 - DNA, 23 bp, Homo sapiens
cctgctgctgctgctgcttcctg

SEQ ID NO: 26060 - DNA, 25 bp, Homo sapiens
gctcactcaagaccagatggagaac

SEQ ID NO: 26061 - DNA, 25 bp, Homo sapiens
cggctctgcacattattcatctcct

SEQ ID NO: 26062 - DNA, 25 bp, Homo sapiens
tggaggaagaggtggtcatcaagcc

SEQ ID NO: 26063 - DNA, 23 bp, Homo sapiens
ggacctgccagccaagaagaagt

SEQ ID NO: 26064 - DNA, 25 bp, Homo sapiens
ctgtgcctggacgatgtgctctatg

SEQ ID NO: 26065 - DNA, 24 bp, Homo sapiens
aagaaaacaatgtgagggacttgt

SEQ ID NO: 26066 - DNA, 24 bp, Homo sapiens
caagaaaacaatgtgagggacttg

SEQ ID NO: 26067 - DNA, 24 bp, Homo sapiens
acaagaaaacaatgtgagggactt

SEQ ID NO: 26068 - DNA, 24 bp, Homo sapiens
ttagtaaccatgctggatttacta

SEQ ID NO: 26069 - DNA, 24 bp, Homo sapiens
tttagtaaccatgctggatttact

SEQ ID NO: 26070 - DNA, 24 bp, Homo sapiens
gtttagtaaccatgctggatttac

SEQ ID NO: 26071 - DNA, 23 bp, Homo sapiens
agacacctgacttctggcaacat

SEQ ID NO: 26072 - DNA, 23 bp, Homo sapiens
cggcattgggctctcaccattgg

SEQ ID NO: 26073 - DNA, 24 bp, Homo sapiens
ctcagaccgaccagcccaagaaac

SEQ ID NO: 26074 - DNA, 24 bp, Homo sapiens
gattagaggcatagtccagcacgc

SEQ ID NO: 26075 - DNA, 24 bp, Homo sapiens
acggagtttctgtcttgttgccca

SEQ ID NO: 26076 - DNA, 23 bp, Homo sapiens
tggtcgggctggtcttgaactcc

SEQ ID NO: 26077 - DNA, 24 bp, Homo sapiens
tgtatattaaggtgtgatttgatt

SEQ ID NO: 26078 - DNA, 24 bp, Homo sapiens
ctgtatattaaggtgtgatttgat

SEQ ID NO: 26079 - DNA, 24 bp, Homo sapiens
actgtatattaaggtgtgatttga

SEQ ID NO: 26080 - DNA, 24 bp, Homo sapiens
ttagaatctcagtaagtttttgaa

SEQ ID NO: 26081 - DNA, 24 bp, Homo sapiens
tttagaatctcagtaagtttttga

SEQ ID NO: 26082 - DNA, 24 bp, Homo sapiens
gtttagaatctcagtaagtttttg

SEQ ID NO: 26083 - DNA, 24 bp, Homo sapiens
ctattttaaagtagaagatggtgg

SEQ ID NO: 26084 - DNA, 24 bp, Homo sapiens
actattttaaagtagaagatggtg

SEQ ID NO: 26085 - DNA, 24 bp, Homo sapiens
cactattttaaagtagaagatggt

SEQ ID NO: 26086 - DNA, 24 bp, Homo sapiens
aaaaaagatagcattgcattactt

SEQ ID NO: 26087 - DNA, 24 bp, Homo sapiens
caaaaaagatagcattgcattact

SEQ ID NO: 26088 - DNA, 24 bp, Homo sapiens
ccaaaaaagatagcattgcattac

SEQ ID NO: 26089 - DNA, 24 bp, Homo sapiens
ggatactttagcaaagttctattt

SEQ ID NO: 26090 - DNA, 24 bp, Homo sapiens
tggatactttagcaaagttctatt

SEQ ID NO: 26091 - DNA, 24 bp, Homo sapiens
gtggatactttagcaaagttctat

SEQ ID NO: 26092 - DNA, 23 bp, Homo sapiens
gccatccttgcacttcagcctcc

SEQ ID NO: 26093 - DNA, 24 bp, Homo sapiens
gctcaggatggagtacagtggtgc

SEQ ID NO: 26094 - DNA, 25 bp, Homo sapiens
ggaaagaactcccatccaggaatca

SEQ ID NO: 26095 - DNA, 25 bp, Homo sapiens
tctcctgttcaagcaattagcctcc

SEQ ID NO: 26096 - DNA, 23 bp, Homo sapiens
gcagtggcacaatctcggctcac

SEQ ID NO: 26097 - DNA, 25 bp, Homo sapiens
agattgccacatcattcggaaagcc

SEQ ID NO: 26098 - DNA, 25 bp, Homo sapiens
acctgaactactgagtggacacatc

SEQ ID NO: 26099 - DNA, 25 bp, Homo sapiens
caccgtgttagccaggatgatctcg

SEQ ID NO: 26100 - DNA, 25 bp, Homo sapiens
tggagtacagtggtatgatcttggc

SEQ ID NO: 26101 - DNA, 24 bp, Homo sapiens
ctgcagaaccgtggcagagaagcc

SEQ ID NO: 26102 - DNA, 24 bp, Homo sapiens
cctgcagaaccgtggcagagaagc

SEQ ID NO: 26103 - DNA, 24 bp, Homo sapiens
tcctgcagaaccgtggcagagaag

SEQ ID NO: 26104 - DNA, 24 bp, Homo sapiens
acatgcacaaggcaaaaattctga

SEQ ID NO: 26105 - DNA, 24 bp, Homo sapiens
tacatgcacaaggcaaaaattctg

SEQ ID NO: 26106 - DNA, 24 bp, Homo sapiens
ttacatgcacaaggcaaaaattct

SEQ ID NO: 26107 - DNA, 24 bp, Homo sapiens
taggagaatttgtctttattttct

SEQ ID NO: 26108 - DNA, 24 bp, Homo sapiens
ataggagaatttgtctttattttc

SEQ ID NO: 26109 - DNA, 24 bp, Homo sapiens
gataggagaatttgtctttatttt

SEQ ID NO: 26110 - DNA, 24 bp, Homo sapiens
attttacacagatggcaatcagga

SEQ ID NO: 26111 - DNA, 24 bp, Homo sapiens
aattttacacagatggcaatcagg

SEQ ID NO: 26112 - DNA, 24 bp, Homo sapiens
gaattttacacagatggcaatcag

SEQ ID NO: 26113 - DNA, 24 bp, Homo sapiens
ctaaaaataaggtaacctttaaat

SEQ ID NO: 26114 - DNA, 24 bp, Homo sapiens
gctaaaaataaggtaacctttaaa

SEQ ID NO: 26115 - DNA, 24 bp, Homo sapiens
tgctaaaaataaggtaacctttaa

SEQ ID NO: 26116 - DNA, 24 bp, Homo sapiens
cattgatgaaggtaatcagtaatt

SEQ ID NO: 26117 - DNA, 24 bp, Homo sapiens
acattgatgaaggtaatcagtaat

SEQ ID NO: 26118 - DNA, 24 bp, Homo sapiens
tacattgatgaaggtaatcagtaa

SEQ ID NO: 26119 - DNA, 24 bp, Homo sapiens
catgttgaaatgttagtaaacctt

SEQ ID NO: 26120 - DNA, 24 bp, Homo sapiens
acatgttgaaatgttagtaaacct

SEQ ID NO: 26121 - DNA, 24 bp, Homo sapiens
gacatgttgaaatgttagtaaacc

SEQ ID NO: 26122 - DNA, 24 bp, Homo sapiens
ctgggcgagaggctgcggcatgtt

SEQ ID NO: 26123 - DNA, 24 bp, Homo sapiens
cctgggcgagaggctgcggcatgt

SEQ ID NO: 26124 - DNA, 24 bp, Homo sapiens
ccctgggcgagaggctgcggcatg

SEQ ID NO: 26125 - DNA, 24 bp, Homo sapiens
cctgggcagaggctggagtgcagt

SEQ ID NO: 26126 - DNA, 24 bp, Homo sapiens
ccctgggcagaggctggagtgcag

SEQ ID NO: 26127 - DNA, 24 bp, Homo sapiens
cccctgggcagaggctggagtgca

SEQ ID NO: 26128 - DNA, 25 bp, Homo sapiens
aaagacccgtcagagtgttcagcaa

SEQ ID NO: 26129 - DNA, 25 bp, Homo sapiens
ggcaggtctggacatagagttcacg

SEQ ID NO: 26130 - DNA, 24 bp, Homo sapiens
gtgaggagtgctggcgatgttctg

SEQ ID NO: 26131 - DNA, 24 bp, Homo sapiens
acataacaggaatgatgaagtagg

SEQ ID NO: 26132 - DNA, 24 bp, Homo sapiens
tacataacaggaatgatgaagtag

SEQ ID NO: 26133 - DNA, 24 bp, Homo sapiens
ttacataacaggaatgatgaagta

SEQ ID NO: 26134 - DNA, 24 bp, Homo sapiens
ttgcttttatgctttgtatgactc

SEQ ID NO: 26135 - DNA, 24 bp, Homo sapiens
attgcttttatgctttgtatgact

SEQ ID NO: 26136 - DNA, 24 bp, Homo sapiens
gattgcttttatgctttgtatgac

SEQ ID NO: 26137 - DNA, 23 bp, Homo sapiens
cagtgagctgtgatcgtgccatc

SEQ ID NO: 26138 - DNA, 23 bp, Homo sapiens
gcaatctagcctgggcaatagaa

SEQ ID NO: 26139 - DNA, 25 bp, Homo sapiens
actttggaataacaggaagaaagga

SEQ ID NO: 26140 - DNA, 24 bp, Homo sapiens
agctgaaacagatgttggcgaaga

SEQ ID NO: 26141 - DNA, 24 bp, Homo sapiens
gagctgaaacagatgttggcgaag

SEQ ID NO: 26142 - DNA, 24 bp, Homo sapiens
ggagctgaaacagatgttggcgaa

SEQ ID NO: 26143 - DNA, 24 bp, Homo sapiens
agatagaagagtatatgcggatga

SEQ ID NO: 26144 - DNA, 24 bp, Homo sapiens
cagatagaagagtatatgcggatg

SEQ ID NO: 26145 - DNA, 24 bp, Homo sapiens
acagatagaagagtatatgcggat

SEQ ID NO: 26146 - DNA, 24 bp, Homo sapiens
caagtcaatcaaactcttcaggat

SEQ ID NO: 26147 - DNA, 24 bp, Homo sapiens
gcaagtcaatcaaactcttcagga

SEQ ID NO: 26148 - DNA, 24 bp, Homo sapiens
agcaagtcaatcaaactcttcagg

SEQ ID NO: 26149 - DNA, 23 bp, Homo sapiens
gaaccagcagcacagactcaggc

SEQ ID NO: 26150 - DNA, 23 bp, Homo sapiens
cagcgtgcgaacagatgtggtaa

SEQ ID NO: 26151 - DNA, 25 bp, Homo sapiens
agttccaccctcagaatctaccagc

SEQ ID NO: 26152 - DNA, 24 bp, Homo sapiens
gaaaaaccaaggtgtggtataatc

SEQ ID NO: 26153 - DNA, 24 bp, Homo sapiens
tgaaaaaccaaggtgtggtataat

SEQ ID NO: 26154 - DNA, 24 bp, Homo sapiens
ctgaaaaaccaaggtgtggtataa

SEQ ID NO: 26155 - DNA, 25 bp, Homo sapiens
tggctacaggatgtactggttcaca

SEQ ID NO: 26156 - DNA, 24 bp, Homo sapiens
tggtgagggacagggtgattggag

SEQ ID NO: 26157 - DNA, 24 bp, Homo sapiens
atcctggagagcatccgtcagtgt

SEQ ID NO: 26158 - DNA, 25 bp, Homo sapiens
ttgccgttattgtcgccttccagtt

SEQ ID NO: 26159 - DNA, 25 bp, Homo sapiens
tggctacaggatgtactggttcaca

SEQ ID NO: 26160 - DNA, 24 bp, Homo sapiens
tggtgagggacagggtgattggag

SEQ ID NO: 26161 - DNA, 23 bp, Homo sapiens
gaaggctgtgctgcggtgctgac

SEQ ID NO: 26162 - DNA, 24 bp, Homo sapiens
ccaagcggaaactctctacagccc

SEQ ID NO: 26163 - DNA, 23 bp, Homo sapiens
gttgctggagacctcatcaggcg

SEQ ID NO: 26164 - DNA, 24 bp, Homo sapiens
agcgattctcttgtctcagcctcc

SEQ ID NO: 26165 - DNA, 24 bp, Homo sapiens
ggctgctcccatctgtagaggtga

SEQ ID NO: 26166 - DNA, 24 bp, Homo sapiens
cgtagtcttctatgctgacagaat

SEQ ID NO: 26167 - DNA, 24 bp, Homo sapiens
ggactggctgctctacggaaggaa

SEQ ID NO: 26168 - DNA, 24 bp, Homo sapiens
agagactggaacacaggcaggcag

SEQ ID NO: 26169 - DNA, 24 bp, Homo sapiens
ctgtgattcagagccagaaggagc

SEQ ID NO: 26170 - DNA, 24 bp, Homo sapiens
ggagcagccaggccagcgcaggac

SEQ ID NO: 26171 - DNA, 24 bp, Homo sapiens
tggagcagccaggccagcgcagga

SEQ ID NO: 26172 - DNA, 24 bp, Homo sapiens
atggagcagccaggccagcgcagg

SEQ ID NO: 26173 - DNA, 24 bp, Homo sapiens
ggggagcataggattgctgctggg

SEQ ID NO: 26174 - DNA, 24 bp, Homo sapiens
aggggagcataggattgctgctgg

SEQ ID NO: 26175 - DNA, 24 bp, Homo sapiens
aaggggagcataggattgctgctg

SEQ ID NO: 26176 - DNA, 24 bp, Homo sapiens
ccatctcttggtggattcagacat

SEQ ID NO: 26177 - DNA, 25 bp, Homo sapiens
aggagtagagtatcacaatgctgga

SEQ ID NO: 26178 - DNA, 25 bp, Homo sapiens
aaggcggtgacagtgatacagactt

SEQ ID NO: 26179 - DNA, 24 bp, Homo sapiens
ggccagggaaaggcggggtcaggg

SEQ ID NO: 26180 - DNA, 24 bp, Homo sapiens
gggccagggaaaggcggggtcagg

SEQ ID NO: 26181 - DNA, 24 bp, Homo sapiens
ggggccagggaaaggcggggtcag

SEQ ID NO: 26182 - DNA, 24 bp, Homo sapiens
ggagaaaggagacaggcaggcaac

SEQ ID NO: 26183 - DNA, 24 bp, Homo sapiens
gctgcttctaaaccctttgcgtgc

SEQ ID NO: 26184 - DNA, 25 bp, Homo sapiens
ctccaggagagagctttgtttaccc

SEQ ID NO: 26185 - DNA, 24 bp, Homo sapiens
ggagaaaggagacaggcaggcaac

SEQ ID NO: 26186 - DNA, 24 bp, Homo sapiens
gctgcttctaaaccctttgcgtgc

SEQ ID NO: 26187 - DNA, 24 bp, Homo sapiens
aacgggctgctcattcattagggc

SEQ ID NO: 26188 - DNA, 24 bp, Homo sapiens
cgccgtctgctgttacctcttctg

SEQ ID NO: 26189 - DNA, 25 bp, Homo sapiens
agaatgagaccatctggtacgtgcg

SEQ ID NO: 26190 - DNA, 23 bp, Homo sapiens
gctctcggaatgactgtggctcc

SEQ ID NO: 26191 - DNA, 25 bp, Homo sapiens
cgtcatcgttggagtcttcctagca

SEQ ID NO: 26192 - DNA, 23 bp, Homo sapiens
ctgctgaccctgcccttcttccc

SEQ ID NO: 26193 - DNA, 24 bp, Homo sapiens
cagaaaggagatgaagccacagcg

SEQ ID NO: 26194 - DNA, 23 bp, Homo sapiens
gacctctgtcccatctgcctgag

SEQ ID NO: 26195 - DNA, 24 bp, Homo sapiens
tgggtttcaggctcatcgagaggt

SEQ ID NO: 26196 - DNA, 23 bp, Homo sapiens
tgccaccttctgggcctggggaa

SEQ ID NO: 26197 - DNA, 24 bp, Homo sapiens
gcctcacactgtctgacctgtacc

SEQ ID NO: 26198 - DNA, 25 bp, Homo sapiens
ttcaccttcagcaagttccttccag

SEQ ID NO: 26199 - DNA, 23 bp, Homo sapiens
tggtagaggcagcagcagacggc

SEQ ID NO: 26200 - DNA, 24 bp, Homo sapiens
tctttgtttagtaagaagccatta

SEQ ID NO: 26201 - DNA, 24 bp, Homo sapiens
ttctttgtttagtaagaagccatt

SEQ ID NO: 26202 - DNA, 24 bp, Homo sapiens
tttctttgtttagtaagaagccat

SEQ ID NO: 26203 - DNA, 24 bp, Homo sapiens
tcctcccttagccatacatcgaag

SEQ ID NO: 26204 - DNA, 24 bp, Homo sapiens
ttcctcccttagccatacatcgaa

SEQ ID NO: 26205 - DNA, 24 bp, Homo sapiens
cttcctcccttagccatacatcga

SEQ ID NO: 26206 - DNA, 24 bp, Homo sapiens
aaatctttaaggtctgcaataatt

SEQ ID NO: 26207 - DNA, 24 bp, Homo sapiens
aaaatctttaaggtctgcaataat

SEQ ID NO: 26208 - DNA, 24 bp, Homo sapiens
aaaaatctttaaggtctgcaataa

SEQ ID NO: 26209 - DNA, 24 bp, Homo sapiens
gtgtctggatttccgtggaggtgt

SEQ ID NO: 26210 - DNA, 24 bp, Homo sapiens
agactggagctgttcctattcggc

SEQ ID NO: 26211 - DNA, 24 bp, Homo sapiens
gtcatttcctctgctgcaaaatag

SEQ ID NO: 26212 - DNA, 24 bp, Homo sapiens
aaaaaacctagataaaggaatatg

SEQ ID NO: 26213 - DNA, 24 bp, Homo sapiens
taaaaaacctagataaaggaatat

SEQ ID NO: 26214 - DNA, 24 bp, Homo sapiens
ttaaaaaacctagataaaggaata

SEQ ID NO: 26215 - DNA, 24 bp, Homo sapiens
ctcacctcggaggctgccatttct

SEQ ID NO: 26216 - DNA, 24 bp, Homo sapiens
ccactgcccacccatcctgcctgg

SEQ ID NO: 26217 - DNA, 24 bp, Homo sapiens
gcttccccaaggagtgctgtagcc

SEQ ID NO: 26218 - DNA, 24 bp, Homo sapiens
ttctcaattagctctacaatgtct

SEQ ID NO: 26219 - DNA, 24 bp, Homo sapiens
tttctcaattagctctacaatgtc

SEQ ID NO: 26220 - DNA, 24 bp, Homo sapiens
ttttctcaattagctctacaatgt

SEQ ID NO: 26221 - DNA, 24 bp, Homo sapiens
acaccaatgctgtcatccatgagg

SEQ ID NO: 26222 - DNA, 24 bp, Homo sapiens
gaatgggcaacatcatccccctga

SEQ ID NO: 26223 - DNA, 24 bp, Homo sapiens
gcagcagccgagcacagccgcccg

SEQ ID NO: 26224 - DNA, 24 bp, Homo sapiens
gtacacatttggtaagtaatttac

SEQ ID NO: 26225 - DNA, 24 bp, Homo sapiens
agtacacatttggtaagtaattta

SEQ ID NO: 26226 - DNA, 24 bp, Homo sapiens
tagtacacatttggtaagtaattt

SEQ ID NO: 26227 - DNA, 24 bp, Homo sapiens
tcaaatatgtggtagaagatgtcc

SEQ ID NO: 26228 - DNA, 24 bp, Homo sapiens
atcaaatatgtggtagaagatgtc

SEQ ID NO: 26229 - DNA, 24 bp, Homo sapiens
aatcaaatatgtggtagaagatgt

SEQ ID NO: 26230 - DNA, 24 bp, Homo sapiens
ctcatcataaggttagagaatata

SEQ ID NO: 26231 - DNA, 24 bp, Homo sapiens
actcatcataaggttagagaatat

SEQ ID NO: 26232 - DNA, 24 bp, Homo sapiens
aactcatcataaggttagagaata

SEQ ID NO: 26233 - DNA, 24 bp, Homo sapiens
ttcttttctagcttgaagtacaat

SEQ ID NO: 26234 - DNA, 24 bp, Homo sapiens
tttcttttctagcttgaagtacaa

SEQ ID NO: 26235 - DNA, 24 bp, Homo sapiens
ttttcttttctagcttgaagtaca

SEQ ID NO: 26236 - DNA, 24 bp, Homo sapiens
cagcctgcttggtaaggggctgcg

SEQ ID NO: 26237 - DNA, 24 bp, Homo sapiens
tcagcctgcttggtaaggggctgc

SEQ ID NO: 26238 - DNA, 24 bp, Homo sapiens
atcagcctgcttggtaaggggctg

SEQ ID NO: 26239 - DNA, 25 bp, Homo sapiens
gcactcatcagcagcatggattcct

SEQ ID NO: 26240 - DNA, 25 bp, Homo sapiens
gacccatacactgacatcccgcaat

SEQ ID NO: 26241 - DNA, 24 bp, Homo sapiens
gcctaatggatggttctcctcatt

SEQ ID NO: 26242 - DNA, 24 bp, Homo sapiens
acaaacaaaagcaccgactagatt

SEQ ID NO: 26243 - DNA, 24 bp, Homo sapiens
gacaaacaaaagcaccgactagat

SEQ ID NO: 26244 - DNA, 24 bp, Homo sapiens
cgacaaacaaaagcaccgactaga

SEQ ID NO: 26245 - DNA, 24 bp, Homo sapiens
atgatgccgtggtacagatggagt

SEQ ID NO: 26246 - DNA, 24 bp, Homo sapiens
gattccaacttatgctcttcacca

SEQ ID NO: 26247 - DNA, 24 bp, Homo sapiens
ggttcagtaagaagaaggacagca

SEQ ID NO: 26248 - DNA, 24 bp, Homo sapiens
gatcatcaaaagtaagttagtact

SEQ ID NO: 26249 - DNA, 24 bp, Homo sapiens
agatcatcaaaagtaagttagtac

SEQ ID NO: 26250 - DNA, 24 bp, Homo sapiens
tagatcatcaaaagtaagttagta

SEQ ID NO: 26251 - DNA, 24 bp, Homo sapiens
tattttcatagattcaaaacaaag

SEQ ID NO: 26252 - DNA, 24 bp, Homo sapiens
atattttcatagattcaaaacaaa

SEQ ID NO: 26253 - DNA, 24 bp, Homo sapiens
tatattttcatagattcaaaacaa

SEQ ID NO: 26254 - DNA, 24 bp, Homo sapiens
tctttcaatcaattaatatagtgc

SEQ ID NO: 26255 - DNA, 24 bp, Homo sapiens
gtctttcaatcaattaatatagtg

SEQ ID NO: 26256 - DNA, 24 bp, Homo sapiens
agtctttcaatcaattaatatagt

SEQ ID NO: 26257 - DNA, 24 bp, Homo sapiens
gacgtcagaaggtaattttattat

SEQ ID NO: 26258 - DNA, 24 bp, Homo sapiens
ggacgtcagaaggtaattttatta

SEQ ID NO: 26259 - DNA, 24 bp, Homo sapiens
aggacgtcagaaggtaattttatt

SEQ ID NO: 26260 - DNA, 23 bp, Homo sapiens
gaccagtgcaagcctacaacccg

SEQ ID NO: 26261 - DNA, 23 bp, Homo sapiens
cggtgcagcaggagcctcagaac

SEQ ID NO: 26262 - DNA, 23 bp, Homo sapiens
agagagctggctgcctggagtac

SEQ ID NO: 26263 - DNA, 24 bp, Homo sapiens
ggacatccctgatcagcgacatcg

SEQ ID NO: 26264 - DNA, 24 bp, Homo sapiens
aggacatccctgatcagcgacatc

SEQ ID NO: 26265 - DNA, 24 bp, Homo sapiens
gaggacatccctgatcagcgacat

SEQ ID NO: 26266 - DNA, 24 bp, Homo sapiens
aagtggagtcatgcttcacacggc

SEQ ID NO: 26267 - DNA, 25 bp, Homo sapiens
ggtctggctgtggtgttaatcttca

SEQ ID NO: 26268 - DNA, 23 bp, Homo sapiens
ccgctcgctgtgagtgctctgcc

SEQ ID NO: 26269 - DNA, 23 bp, Homo sapiens
ctgaccacgaccacaccacaggc

SEQ ID NO: 26270 - DNA, 23 bp, Homo sapiens
cacagtgcccacctgctctccag

SEQ ID NO: 26271 - DNA, 24 bp, Homo sapiens
acggagtgtctcagcttctggtac

SEQ ID NO: 26272 - DNA, 23 bp, Homo sapiens
ggctggcaggagttggcagtgac

SEQ ID NO: 26273 - DNA, 24 bp, Homo sapiens
acttccgagtgaccttctctgcca

SEQ ID NO: 26274 - DNA, 24 bp, Homo sapiens
ggacaccaccactgccagaacaag

SEQ ID NO: 26275 - DNA, 25 bp, Homo sapiens
gccaccaacttcagagactatgcca

SEQ ID NO: 26276 - DNA, 23 bp, Homo sapiens
cgagcccttcaacaccgtggagc

SEQ ID NO: 26277 - DNA, 23 bp, Homo sapiens
tgacggagacagccagccaggag

SEQ ID NO: 26278 - DNA, 25 bp, Homo sapiens
aaccatcgtactaatgccccgttca

SEQ ID NO: 26279 - DNA, 23 bp, Homo sapiens
gggtgctgctgctcgggcctgtg

SEQ ID NO: 26280 - DNA, 23 bp, Homo sapiens
ggaaaagtctgcaggccgccctc

SEQ ID NO: 26281 - DNA, 24 bp, Homo sapiens
atttatcaatggtaagaattacct

SEQ ID NO: 26282 - DNA, 24 bp, Homo sapiens
gatttatcaatggtaagaattacc

SEQ ID NO: 26283 - DNA, 24 bp, Homo sapiens
tgatttatcaatggtaagaattac

SEQ ID NO: 26284 - DNA, 24 bp, Homo sapiens
ctgctgctggtggtctgtgaagtt

SEQ ID NO: 26285 - DNA, 23 bp, Homo sapiens
tgccatgacctttctctggggct

SEQ ID NO: 26286 - DNA, 24 bp, Homo sapiens
gaaaaccacaggtacaaataatgt

SEQ ID NO: 26287 - DNA, 24 bp, Homo sapiens
attcggacgaggatgccctgaagg

SEQ ID NO: 26288 - DNA, 24 bp, Homo sapiens
gattcggacgaggatgccctgaag

SEQ ID NO: 26289 - DNA, 24 bp, Homo sapiens
agattcggacgaggatgccctgaa

SEQ ID NO: 26290 - DNA, 25 bp, Homo sapiens
tggagaagactgattgctggaatgc

SEQ ID NO: 26291 - DNA, 23 bp, Homo sapiens
ttctcctgcctcaccctcccaag

SEQ ID NO: 26292 - DNA, 25 bp, Homo sapiens
tgaataccaagtcccaagagtctgc

SEQ ID NO: 26293 - DNA, 25 bp, Homo sapiens
gaataggagtggtgagagaaggcat

SEQ ID NO: 26294 - DNA, 24 bp, Homo sapiens
aagagcaatggctgaaatgttggc

SEQ ID NO: 26295 - DNA, 25 bp, Homo sapiens
cttgtgccagttttcaaaggttaca

SEQ ID NO: 26296 - DNA, 24 bp, Homo sapiens
atggcaaaacagttcgtccatcct

SEQ ID NO: 26297 - DNA, 24 bp, Homo sapiens
aatggcaaaacagttcgtccatcc

SEQ ID NO: 26298 - DNA, 24 bp, Homo sapiens
gaatggcaaaacagttcgtccatc

SEQ ID NO: 26299 - DNA, 25 bp, Homo sapiens
ttctgtcagtaaccaacatggcggt

SEQ ID NO: 26300 - DNA, 25 bp, Homo sapiens
tcaagttcctgaggcgttcaccaac

SEQ ID NO: 26301 - DNA, 25 bp, Homo sapiens
agcatcatcagcacagagcacattc

SEQ ID NO: 26302 - DNA, 24 bp, Homo sapiens
ctttgattcagatgatatgaagtt

SEQ ID NO: 26303 - DNA, 24 bp, Homo sapiens
actttgattcagatgatatgaagt

SEQ ID NO: 26304 - DNA, 24 bp, Homo sapiens
cactttgattcagatgatatgaag

SEQ ID NO: 26305 - DNA, 24 bp, Homo sapiens
gcgttagccagtatgttctccagc

SEQ ID NO: 26306 - DNA, 23 bp, Homo sapiens
gtgatccacccgccttggcctcc

SEQ ID NO: 26307 - DNA, 25 bp, Homo sapiens
acatagagacagcagacctggatgg

SEQ ID NO: 26308 - DNA, 24 bp, Homo sapiens
gtgacatggaagatcgcctggagc

SEQ ID NO: 26309 - DNA, 24 bp, Homo sapiens
aatggagaagtgagatgtgaggct

SEQ ID NO: 26310 - DNA, 24 bp, Homo sapiens
ggagaagctgcaacaggtggacag

SEQ ID NO: 26311 - DNA, 25 bp, Homo sapiens
cctacagacaacatcgtgggcacaa

SEQ ID NO: 26312 - DNA, 23 bp, Homo sapiens
atggtgtgtgtgatgctgccgga

SEQ ID NO: 26313 - DNA, 25 bp, Homo sapiens
tattgatgataaaggaatacttttt

SEQ ID NO: 26314 - DNA, 24 bp, Homo sapiens
tcaattagaatataaagaagcatg

SEQ ID NO: 26315 - DNA, 24 bp, Homo sapiens
ttcaattagaatataaagaagcat

SEQ ID NO: 26316 - DNA, 24 bp, Homo sapiens
cttcaattagaatataaagaagca

SEQ ID NO: 26317 - DNA, 25 bp, Homo sapiens
cacaggatgagataggaggtcggca

SEQ ID NO: 26318 - DNA, 25 bp, Homo sapiens
cctctcctatctcaagccatccttc

SEQ ID NO: 26319 - DNA, 24 bp, Homo sapiens
atgaggctgagacctactgggctg

SEQ ID NO: 26320 - DNA, 25 bp, Homo sapiens
tctggtcgtcctcactgctacactc

SEQ ID NO: 26321 - DNA, 24 bp, Homo sapiens
cgccatgacagtttacagatgcca

SEQ ID NO: 26322 - DNA, 25 bp, Homo sapiens
cgtctggaagttacctgtacggtct

SEQ ID NO: 26323 - DNA, 25 bp, Homo sapiens
gctcagaactctcttcaggcagaca

SEQ ID NO: 26324 - DNA, 25 bp, Homo sapiens
agtcccagtggataccctgcttcag

SEQ ID NO: 26325 - DNA, 25 bp, Homo sapiens
tctggtcgtcctcactgctacactc

SEQ ID NO: 26326 - DNA, 24 bp, Homo sapiens
cagtgctcagggtttaagtattga

SEQ ID NO: 26327 - DNA, 24 bp, Homo sapiens
tcagtgctcagggtttaagtattg

SEQ ID NO: 26328 - DNA, 24 bp, Homo sapiens
ttcagtgctcagggtttaagtatt

SEQ ID NO: 26329 - DNA, 24 bp, Homo sapiens
ttctgtcaatgttaggcataaagc

SEQ ID NO: 26330 - DNA, 24 bp, Homo sapiens
tttctgtcaatgttaggcataaag

SEQ ID NO: 26331 - DNA, 24 bp, Homo sapiens
atttctgtcaatgttaggcataaa

SEQ ID NO: 26332 - DNA, 24 bp, Homo sapiens
ctccagcatgggtaggtgttcccc

SEQ ID NO: 26333 - DNA, 24 bp, Homo sapiens
cctccagcatgggtaggtgttccc

SEQ ID NO: 26334 - DNA, 24 bp, Homo sapiens
ccctccagcatgggtaggtgttcc

SEQ ID NO: 26335 - DNA, 25 bp, Homo sapiens
acctggacctactggaagtctatct

SEQ ID NO: 26336 - DNA, 25 bp, Homo sapiens
acctcatactctaccatgccatctt

SEQ ID NO: 26337 - DNA, 23 bp, Homo sapiens
ttgaactctgcctggtgactgtt

SEQ ID NO: 26338 - DNA, 25 bp, Homo sapiens
accacctctaggcacatcttattga

SEQ ID NO: 26339 - DNA, 25 bp, Homo sapiens
ttccagtgtgatcgttgcagaagac

SEQ ID NO: 26340 - DNA, 24 bp, Homo sapiens
ggccaaataggaacagctccggtc

SEQ ID NO: 26341 - DNA, 24 bp, Homo sapiens
tgaactcctgggctcaagtgatcc

SEQ ID NO: 26342 - DNA, 25 bp, Homo sapiens
gctatgcctggactcaacaacacga

SEQ ID NO: 26343 - DNA, 25 bp, Homo sapiens
tgacaacagagaagatgatgagcct

SEQ ID NO: 26344 - DNA, 24 bp, Homo sapiens
tgcattcattggtaagtatataaa

SEQ ID NO: 26345 - DNA, 24 bp, Homo sapiens
ctgcattcattggtaagtatataa

SEQ ID NO: 26346 - DNA, 24 bp, Homo sapiens
actgcattcattggtaagtatata

SEQ ID NO: 26347 - DNA, 24 bp, Homo sapiens
gttcaaaaaggtttgattttcatc

SEQ ID NO: 26348 - DNA, 24 bp, Homo sapiens
tgttcaaaaaggtttgattttcat

SEQ ID NO: 26349 - DNA, 24 bp, Homo sapiens
atgttcaaaaaggtttgattttca

SEQ ID NO: 26350 - DNA, 23 bp, Homo sapiens
ccgttcctgtcccagacccagag

SEQ ID NO: 26351 - DNA, 23 bp, Homo sapiens
cttgaccaccgcccccaccccac

SEQ ID NO: 26352 - DNA, 23 bp, Homo sapiens
tgtcctgttccctccgcgatgcg

SEQ ID NO: 26353 - DNA, 24 bp, Homo sapiens
ctcagttcatgttcagatattttg

SEQ ID NO: 26354 - DNA, 24 bp, Homo sapiens
tctcagttcatgttcagatatttt

SEQ ID NO: 26355 - DNA, 24 bp, Homo sapiens
atctcagttcatgttcagatattt

SEQ ID NO: 26356 - DNA, 24 bp, Homo sapiens
aatggacttggttttaattcacag

SEQ ID NO: 26357 - DNA, 24 bp, Homo sapiens
caatggacttggttttaattcaca

SEQ ID NO: 26358 - DNA, 24 bp, Homo sapiens
tcaatggacttggttttaattcac

SEQ ID NO: 26359 - DNA, 24 bp, Homo sapiens
atgtctgaatggaagctacaaagt

SEQ ID NO: 26360 - DNA, 24 bp, Homo sapiens
aatgtctgaatggaagctacaaag

SEQ ID NO: 26361 - DNA, 24 bp, Homo sapiens
caatgtctgaatggaagctacaaa

SEQ ID NO: 26362 - DNA, 23 bp, Homo sapiens
gacgaggcttatccaacccacgg

SEQ ID NO: 26363 - DNA, 25 bp, Homo sapiens
gcagcccaacacaaattcgtaaact

SEQ ID NO: 26364 - DNA, 25 bp, Homo sapiens
tccaaagatccagcagggtatcagg

SEQ ID NO: 26365 - DNA, 24 bp, Homo sapiens
agaaaaaatatgtgtgtaaactgc

SEQ ID NO: 26366 - DNA, 24 bp, Homo sapiens
aagaaaaaatatgtgtgtaaactg

SEQ ID NO: 26367 - DNA, 24 bp, Homo sapiens
taagaaaaaatatgtgtgtaaact

SEQ ID NO: 26368 - DNA, 24 bp, Homo sapiens
acaacacaaaggtaaatatttgag

SEQ ID NO: 26369 - DNA, 24 bp, Homo sapiens
tacaacacaaaggtaaatatttga

SEQ ID NO: 26370 - DNA, 24 bp, Homo sapiens
gtacaacacaaaggtaaatatttg

SEQ ID NO: 26371 - DNA, 24 bp, Homo sapiens
acgaaatgtgaatctactagggca

SEQ ID NO: 26372 - DNA, 24 bp, Homo sapiens
tgaagaatgctataccagtttggc

SEQ ID NO: 26373 - DNA, 24 bp, Homo sapiens
actgccctctgagtcagaagatca

SEQ ID NO: 26374 - DNA, 25 bp, Homo sapiens
accaaatgtaactagattaacgcct

SEQ ID NO: 26375 - DNA, 23 bp, Homo sapiens
catatcaaagatgcaaatgggaa

SEQ ID NO: 26376 - DNA, 25 bp, Homo sapiens
atgatacttactatgaaaatgttta

SEQ ID NO: 26377 - DNA, 24 bp, Homo sapiens
ctaacatacagccatagttcaaaa

SEQ ID NO: 26378 - DNA, 24 bp, Homo sapiens
actaacatacagccatagttcaaa

SEQ ID NO: 26379 - DNA, 24 bp, Homo sapiens
gactaacatacagccatagttcaa

SEQ ID NO: 26380 - DNA, 25 bp, Homo sapiens
cctgggagagaatggtatcacagac

SEQ ID NO: 26381 - DNA, 25 bp, Homo sapiens
acactttgggaaattcagaaggagc

SEQ ID NO: 26382 - DNA, 23 bp, Homo sapiens
gtctcattctgtcacccaggctg

SEQ ID NO: 26383 - DNA, 25 bp, Homo sapiens
acactttgggaaattcagaaggagc

SEQ ID NO: 26384 - DNA, 23 bp, Homo sapiens
gtctcattctgtcacccaggctg

SEQ ID NO: 26385 - DNA, 23 bp, Homo sapiens
tcatggctcactgcaaccttggc

SEQ ID NO: 26386 - DNA, 24 bp, Homo sapiens
actaaaagaatatgaggaactgaa

SEQ ID NO: 26387 - DNA, 24 bp, Homo sapiens
gactaaaagaatatgaggaactga

SEQ ID NO: 26388 - DNA, 24 bp, Homo sapiens
agactaaaagaatatgaggaactg

SEQ ID NO: 26389 - DNA, 24 bp, Homo sapiens
ccatttacaaagtaagtgattgtt

SEQ ID NO: 26390 - DNA, 24 bp, Homo sapiens
accatttacaaagtaagtgattgt

SEQ ID NO: 26391 - DNA, 24 bp, Homo sapiens
taccatttacaaagtaagtgattg

SEQ ID NO: 26392 - DNA, 24 bp, Homo sapiens
tctctttccaggtgaagcatatat

SEQ ID NO: 26393 - DNA, 24 bp, Homo sapiens
ttctctttccaggtgaagcatata

SEQ ID NO: 26394 - DNA, 24 bp, Homo sapiens
attctctttccaggtgaagcatat

SEQ ID NO: 26395 - DNA, 24 bp, Homo sapiens
tgttgctttaggtacaaattattt

SEQ ID NO: 26396 - DNA, 24 bp, Homo sapiens
ctgttgctttaggtacaaattatt

SEQ ID NO: 26397 - DNA, 24 bp, Homo sapiens
cctgttgctttaggtacaaattat

SEQ ID NO: 26398 - DNA, 24 bp, Homo sapiens
ttataaatctggggaatactacag

SEQ ID NO: 26399 - DNA, 24 bp, Homo sapiens
gttataaatctggggaatactaca

SEQ ID NO: 26400 - DNA, 24 bp, Homo sapiens
tgttataaatctggggaatactac

SEQ ID NO: 26401 - DNA, 24 bp, Homo sapiens
aagagatgctgtcaggactgtcgc

SEQ ID NO: 26402 - DNA, 25 bp, Homo sapiens
aaagtccatgctaacagggaaccca

SEQ ID NO: 26403 - DNA, 23 bp, Homo sapiens
cttcccgcagcaggcccacgcat

SEQ ID NO: 26404 - DNA, 24 bp, Homo sapiens
tcccactgaagggcatgggagcag

SEQ ID NO: 26405 - DNA, 24 bp, Homo sapiens
ctcccactgaagggcatgggagca

SEQ ID NO: 26406 - DNA, 24 bp, Homo sapiens
tctcccactgaagggcatgggagc

SEQ ID NO: 26407 - DNA, 25 bp, Homo sapiens
actcctgacctcaagcaattcacct

SEQ ID NO: 26408 - DNA, 25 bp, Homo sapiens
agaagcagatcgtcatggcaagagc

SEQ ID NO: 26409 - DNA, 25 bp, Homo sapiens
tctcagatcactacaacctccacct

SEQ ID NO: 26410 - DNA, 24 bp, Homo sapiens
tggacagctcagtgagttggggac

SEQ ID NO: 26411 - DNA, 24 bp, Homo sapiens
ctggacagctcagtgagttgggga

SEQ ID NO: 26412 - DNA, 24 bp, Homo sapiens
cctggacagctcagtgagttgggg

SEQ ID NO: 26413 - DNA, 24 bp, Homo sapiens
gtcagatcacactgcataataaat

SEQ ID NO: 26414 - DNA, 24 bp, Homo sapiens
tgtcagatcacactgcataataaa

SEQ ID NO: 26415 - DNA, 24 bp, Homo sapiens
gtgtcagatcacactgcataataa

SEQ ID NO: 26416 - DNA, 24 bp, Homo sapiens
aacctgaatgtgactgtggacctt

SEQ ID NO: 26417 - DNA, 25 bp, Homo sapiens
ttcccagcagccaaacaaagtgatt

SEQ ID NO: 26418 - DNA, 24 bp, Homo sapiens
ggtcactcctgtgcctggtactca

SEQ ID NO: 26419 - DNA, 25 bp, Homo sapiens
ttcccagcagccaaacaaagtgatt

SEQ ID NO: 26420 - DNA, 24 bp, Homo sapiens
ggtcactcctgtgcctggtactca

SEQ ID NO: 26421 - DNA, 25 bp, Homo sapiens
agtgttagcctgtggtggagatgga

SEQ ID NO: 26422 - DNA, 25 bp, Homo sapiens
ttcccagcagccaaacaaagtgatt

SEQ ID NO: 26423 - DNA, 24 bp, Homo sapiens
aacctgaatgtgactgtggacctt

SEQ ID NO: 26424 - DNA, 25 bp, Homo sapiens
tgcccaaccaagtgtgataagtgcc

SEQ ID NO: 26425 - DNA, 24 bp, Homo sapiens
ggtcactcctgtgcctggtactca

SEQ ID NO: 26426 - DNA, 25 bp, Homo sapiens
ttcccagcagccaaacaaagtgatt

SEQ ID NO: 26427 - DNA, 24 bp, Homo sapiens
accacccacaacaatctgtccagt

SEQ ID NO: 26428 - DNA, 25 bp, Homo sapiens
aaggcagcagttcaggaagatggtg

SEQ ID NO: 26429 - DNA, 25 bp, Homo sapiens
tgcggttccttcaagatgtctgtgt

SEQ ID NO: 26430 - DNA, 23 bp, Homo sapiens
aagagcagcaggcggaggcagag

SEQ ID NO: 26431 - DNA, 24 bp, Homo sapiens
ccgtgatactccagacttccgtgt

SEQ ID NO: 26432 - DNA, 24 bp, Homo sapiens
gtggtggagatgggacagttggct

SEQ ID NO: 26433 - DNA, 24 bp, Homo sapiens
aaatgaccttgcccgttgtctccg

SEQ ID NO: 26434 - DNA, 24 bp, Homo sapiens
tctttggacagatcattggatttg

SEQ ID NO: 26435 - DNA, 24 bp, Homo sapiens
ttctttggacagatcattggattt

SEQ ID NO: 26436 - DNA, 24 bp, Homo sapiens
tttctttggacagatcattggatt

SEQ ID NO: 26437 - DNA, 24 bp, Homo sapiens
agatcatgaaggacccagacagtt

SEQ ID NO: 26438 - DNA, 24 bp, Homo sapiens
cagatcatgaaggacccagacagt

SEQ ID NO: 26439 - DNA, 24 bp, Homo sapiens
gcagatcatgaaggacccagacag

SEQ ID NO: 26440 - DNA, 24 bp, Homo sapiens
acaaactaaagacatttgaattaa

SEQ ID NO: 26441 - DNA, 24 bp, Homo sapiens
gacaaactaaagacatttgaatta

SEQ ID NO: 26442 - DNA, 24 bp, Homo sapiens
agacaaactaaagacatttgaatt

SEQ ID NO: 26443 - DNA, 24 bp, Homo sapiens
tgagattacagatgagaaaactga

SEQ ID NO: 26444 - DNA, 24 bp, Homo sapiens
ctgagattacagatgagaaaactg

SEQ ID NO: 26445 - DNA, 24 bp, Homo sapiens
gctgagattacagatgagaaaact

SEQ ID NO: 26446 - DNA, 25 bp, Homo sapiens
gctgaagaaagacctcctgattggc

SEQ ID NO: 26447 - DNA, 23 bp, Homo sapiens
gagcaggtggcaggttccatgag

SEQ ID NO: 26448 - DNA, 23 bp, Homo sapiens
aggtcagggtccaagccgagaag

SEQ ID NO: 26449 - DNA, 24 bp, Homo sapiens
ttggcacggctattactctgtggc

SEQ ID NO: 26450 - DNA, 24 bp, Homo sapiens
cgtgaacatcaagaaccgagaagg

SEQ ID NO: 26451 - DNA, 24 bp, Homo sapiens
ttgcgacaaggacggacacattgc

SEQ ID NO: 26452 - DNA, 24 bp, Homo sapiens
gcccacaccagaagcagatgccac

SEQ ID NO: 26453 - DNA, 24 bp, Homo sapiens
cgcccacaccagaagcagatgcca

SEQ ID NO: 26454 - DNA, 24 bp, Homo sapiens
acgcccacaccagaagcagatgcc

SEQ ID NO: 26455 - DNA, 24 bp, Homo sapiens
caataaaacaggtatggaattatc

SEQ ID NO: 26456 - DNA, 24 bp, Homo sapiens
ccaataaaacaggtatggaattat

SEQ ID NO: 26457 - DNA, 24 bp, Homo sapiens
tccaataaaacaggtatggaatta

SEQ ID NO: 26458 - DNA, 25 bp, Homo sapiens
cctaatacaggacctaatgctgacc

SEQ ID NO: 26459 - DNA, 23 bp, Homo sapiens
gtccgactgactcctctcaccaa

SEQ ID NO: 26460 - DNA, 23 bp, Homo sapiens
gttgggcatcaggcaggctggac

SEQ ID NO: 26461 - DNA, 24 bp, Homo sapiens
gaggaggaggaggaggaggatgga

SEQ ID NO: 26462 - DNA, 25 bp, Homo sapiens
gaactctgcttcaggtgttaggagg

SEQ ID NO: 26463 - DNA, 23 bp, Homo sapiens
gtcccttgaaaccgctttgtcgc

SEQ ID NO: 26464 - DNA, 24 bp, Homo sapiens
tttgtttacagatatttgatattt

SEQ ID NO: 26465 - DNA, 24 bp, Homo sapiens
atttgtttacagatatttgatatt

SEQ ID NO: 26466 - DNA, 24 bp, Homo sapiens
gatttgtttacagatatttgatat

SEQ ID NO: 26467 - DNA, 25 bp, Homo sapiens
aggcacgaagagcaatgaatactga

SEQ ID NO: 26468 - DNA, 25 bp, Homo sapiens
ctcttgagggcattgaatgtcaggc

SEQ ID NO: 26469 - DNA, 25 bp, Homo sapiens
agccatcatatccctagtgacctgc

SEQ ID NO: 26470 - DNA, 24 bp, Homo sapiens
tcctctctagggtcctgtctcggg

SEQ ID NO: 26471 - DNA, 24 bp, Homo sapiens
aaccctcccacacacctctccttg

SEQ ID NO: 26472 - DNA, 24 bp, Homo sapiens
cctctcagtctccaaggacccgtg

SEQ ID NO: 26473 - DNA, 24 bp, Homo sapiens
gtgtccaaagggtgagtaatttta

SEQ ID NO: 26474 - DNA, 24 bp, Homo sapiens
tgtgtccaaagggtgagtaatttt

SEQ ID NO: 26475 - DNA, 24 bp, Homo sapiens
gtgtgtccaaagggtgagtaattt

SEQ ID NO: 26476 - DNA, 24 bp, Homo sapiens
aagcagccagagcgagagccacag

SEQ ID NO: 26477 - DNA, 24 bp, Homo sapiens
gactatgagcagctccgccaggtg

SEQ ID NO: 26478 - DNA, 24 bp, Homo sapiens
gtcagactttgttcggtccacggg

SEQ ID NO: 26479 - DNA, 24 bp, Homo sapiens
ggattacaggatgagccaccacgc

SEQ ID NO: 26480 - DNA, 25 bp, Homo sapiens
ccagcaatgccagtcggattcttct

SEQ ID NO: 26481 - DNA, 23 bp, Homo sapiens
ctgacctcaagtgatccgcctgc

SEQ ID NO: 26482 - DNA, 25 bp, Homo sapiens
cctgagcgtagagaacatcctgacc

SEQ ID NO: 26483 - DNA, 23 bp, Homo sapiens
cgctctctgccctctgctacatc

SEQ ID NO: 26484 - DNA, 23 bp, Homo sapiens
gcctgccgtttctgctcatctgt

SEQ ID NO: 26485 - DNA, 23 bp, Homo sapiens
ctgtgctggctggctggagttct

SEQ ID NO: 26486 - DNA, 23 bp, Homo sapiens
gccctgctgaggttcttgttccg

SEQ ID NO: 26487 - DNA, 23 bp, Homo sapiens
ccaagggcaaggagcagtccgtg

SEQ ID NO: 26488 - DNA, 23 bp, Homo sapiens
gaccgtggctacatctactggcg

SEQ ID NO: 26489 - DNA, 24 bp, Homo sapiens
aaggaggtggtgttggctgagaag

SEQ ID NO: 26490 - DNA, 23 bp, Homo sapiens
gctacatcggcacgctggcttcc

SEQ ID NO: 26491 - DNA, 24 bp, Homo sapiens
atcaacacctgaggagccaacagc

SEQ ID NO: 26492 - DNA, 25 bp, Homo sapiens
cagggaggtggagatgctttattca

SEQ ID NO: 26493 - DNA, 25 bp, Homo sapiens
acttgggaagagtttactatgagcc

SEQ ID NO: 26494 - DNA, 25 bp, Homo sapiens
aacatcagactccaagttcttcagc

SEQ ID NO: 26495 - DNA, 23 bp, Homo sapiens
ccacgaactgaaggctgcactgt

SEQ ID NO: 26496 - DNA, 25 bp, Homo sapiens
ttgcacctcagcttacagatgacct

SEQ ID NO: 26497 - DNA, 24 bp, Homo sapiens
tgtttcctaagacctttccaggtg

SEQ ID NO: 26498 - DNA, 24 bp, Homo sapiens
ttgtttcctaagacctttccaggt

SEQ ID NO: 26499 - DNA, 24 bp, Homo sapiens
cttgtttcctaagacctttccagg

SEQ ID NO: 26500 - DNA, 24 bp, Homo sapiens
gccaagacccgacgcattagacaa

SEQ ID NO: 26501 - DNA, 25 bp, Homo sapiens
tctgccaccatgtagctgaagtctg

SEQ ID NO: 26502 - DNA, 25 bp, Homo sapiens
ttgctgagctgtgggatactgacct

SEQ ID NO: 26503 - DNA, 25 bp, Homo sapiens
cgctacctgacatacatcttcatgc

SEQ ID NO: 26504 - DNA, 23 bp, Homo sapiens
cctgggactcaatgtggtgctgc

SEQ ID NO: 26505 - DNA, 23 bp, Homo sapiens
gtccttggcagtgtctgtggctg

SEQ ID NO: 26506 - DNA, 25 bp, Homo sapiens
agagatgtgatgttggagaactaca

SEQ ID NO: 26507 - DNA, 24 bp, Homo sapiens
ggaaatgcctagaccctgcccaac

SEQ ID NO: 26508 - DNA, 25 bp, Homo sapiens
ccctgaagccgagaaatggaactct

SEQ ID NO: 26509 - DNA, 25 bp, Homo sapiens
gtggaaggctgggttcattggacat

SEQ ID NO: 26510 - DNA, 23 bp, Homo sapiens
accgagtcaccgaacgagcaaga

SEQ ID NO: 26511 - DNA, 25 bp, Homo sapiens
actccatgagcctaacaactgatga

SEQ ID NO: 26512 - DNA, 24 bp, Homo sapiens
tggaaaacaatgtaagttctctta

SEQ ID NO: 26513 - DNA, 24 bp, Homo sapiens
atggaaaacaatgtaagttctctt

SEQ ID NO: 26514 - DNA, 24 bp, Homo sapiens
aatggaaaacaatgtaagttctct

SEQ ID NO: 26515 - DNA, 24 bp, Homo sapiens
tctggctcaattattagtcggaca

SEQ ID NO: 26516 - DNA, 24 bp, Homo sapiens
ccagacaccacaagccagatgagg

SEQ ID NO: 26517 - DNA, 24 bp, Homo sapiens
tgggaatggatgaaaggaagcagc

SEQ ID NO: 26518 - DNA, 24 bp, Homo sapiens
cctcgtgccgtcattgtgagttgg

SEQ ID NO: 26519 - DNA, 24 bp, Homo sapiens
gactgcacatgccaccacgtatga

SEQ ID NO: 26520 - DNA, 24 bp, Homo sapiens
tctctaagttacacagcaacaggc

SEQ ID NO: 26521 - DNA, 24 bp, Homo sapiens
tgaggagcagggaagcatggctat

SEQ ID NO: 26522 - DNA, 25 bp, Homo sapiens
gccatgttcaagatatgctgtctag

SEQ ID NO: 26523 - DNA, 25 bp, Homo sapiens
gtgtcagaagttcttgccttgagga

SEQ ID NO: 26524 - DNA, 24 bp, Homo sapiens
aatttggctaagttgggattgagt

SEQ ID NO: 26525 - DNA, 24 bp, Homo sapiens
taatttggctaagttgggattgag

SEQ ID NO: 26526 - DNA, 24 bp, Homo sapiens
ataatttggctaagttgggattga

SEQ ID NO: 26527 - DNA, 24 bp, Homo sapiens
acccttttcagtgatttatagagg

SEQ ID NO: 26528 - DNA, 24 bp, Homo sapiens
tacccttttcagtgatttatagag

SEQ ID NO: 26529 - DNA, 24 bp, Homo sapiens
ttacccttttcagtgatttataga

SEQ ID NO: 26530 - DNA, 24 bp, Homo sapiens
ttggagaccaggaaatactacaga

SEQ ID NO: 26531 - DNA, 24 bp, Homo sapiens
tttggagaccaggaaatactacag

SEQ ID NO: 26532 - DNA, 24 bp, Homo sapiens
ctttggagaccaggaaatactaca

SEQ ID NO: 26533 - DNA, 23 bp, Homo sapiens
gcagtgagccaagatcgcaccat

SEQ ID NO: 26534 - DNA, 23 bp, Homo sapiens
agaacctctccatcatcttccgc

SEQ ID NO: 26535 - DNA, 25 bp, Homo sapiens
tctagcaccaggactcagaggatga

SEQ ID NO: 26536 - DNA, 24 bp, Homo sapiens
ccagagcgagttcgactgcttctc

SEQ ID NO: 26537 - DNA, 23 bp, Homo sapiens
atggacgccgaactcatcgacga

SEQ ID NO: 26538 - DNA, 23 bp, Homo sapiens
ctgacgtcgctggagctggagct

SEQ ID NO: 26539 - DNA, 24 bp, Homo sapiens
accagctcttggtactctaatttt

SEQ ID NO: 26540 - DNA, 24 bp, Homo sapiens
gaccagctcttggtactctaattt

SEQ ID NO: 26541 - DNA, 24 bp, Homo sapiens
agaccagctcttggtactctaatt

SEQ ID NO: 26542 - DNA, 24 bp, Homo sapiens
agtggtccctacatcctacgaaac

SEQ ID NO: 26543 - DNA, 24 bp, Homo sapiens
aatgtctgtggctctcagcaaggc

SEQ ID NO: 26544 - DNA, 24 bp, Homo sapiens
tgacggtggacagcctagtgaaca

SEQ ID NO: 26545 - DNA, 24 bp, Homo sapiens
agtactatcagcatctgtacagca

SEQ ID NO: 26546 - DNA, 24 bp, Homo sapiens
aagtactatcagcatctgtacagc

SEQ ID NO: 26547 - DNA, 24 bp, Homo sapiens
caagtactatcagcatctgtacag

SEQ ID NO: 26548 - DNA, 23 bp, Homo sapiens
cctcacctctcctggagcagtcc

SEQ ID NO: 26549 - DNA, 23 bp, Homo sapiens
ctgagcagcagtgagcccagcac

SEQ ID NO: 26550 - DNA, 23 bp, Homo sapiens
ctggcagcacccatcatccccac

SEQ ID NO: 26551 - DNA, 24 bp, Homo sapiens
gaccacatgaggccaatgatttat

SEQ ID NO: 26552 - DNA, 24 bp, Homo sapiens
tgaccacatgaggccaatgattta

SEQ ID NO: 26553 - DNA, 24 bp, Homo sapiens
atgaccacatgaggccaatgattt

SEQ ID NO: 26554 - DNA, 24 bp, Homo sapiens
gagcactccttatatccttcccag

SEQ ID NO: 26555 - DNA, 24 bp, Homo sapiens
cgagcactccttatatccttccca

SEQ ID NO: 26556 - DNA, 24 bp, Homo sapiens
tcgagcactccttatatccttccc

SEQ ID NO: 26557 - DNA, 24 bp, Homo sapiens
atctccacaggctgcgaggtgcgc

SEQ ID NO: 26558 - DNA, 24 bp, Homo sapiens
gatctccacaggctgcgaggtgcg

SEQ ID NO: 26559 - DNA, 24 bp, Homo sapiens
ggatctccacaggctgcgaggtgc

SEQ ID NO: 26560 - DNA, 24 bp, Homo sapiens
cgtcaggaccctccaccagcataa

SEQ ID NO: 26561 - DNA, 24 bp, Homo sapiens
cccacagatcctgccaccatgccg

SEQ ID NO: 26562 - DNA, 24 bp, Homo sapiens
ctcagactgcctctgggtggggct

SEQ ID NO: 26563 - DNA, 24 bp, Homo sapiens
gactgtgatgatggactggctcgg

SEQ ID NO: 26564 - DNA, 24 bp, Homo sapiens
ggtggcttactcatccgatcaggc

SEQ ID NO: 26565 - DNA, 24 bp, Homo sapiens
gctgggttaattggtggagtgaaa

SEQ ID NO: 26566 - DNA, 24 bp, Homo sapiens
tggagttgttaaccaggatggcct

SEQ ID NO: 26567 - DNA, 24 bp, Homo sapiens
ctgatctcatgatccgcccagctc

SEQ ID NO: 26568 - DNA, 23 bp, Homo sapiens
gtgacggcaatggcttcatctcc

SEQ ID NO: 26569 - DNA, 25 bp, Homo sapiens
atggatggtgatggtcaagtggact

SEQ ID NO: 26570 - DNA, 23 bp, Homo sapiens
gctgctctacgacaccttctgcg

SEQ ID NO: 26571 - DNA, 24 bp, Homo sapiens
agaggataaagcagtcctgaagtg

SEQ ID NO: 26572 - DNA, 24 bp, Homo sapiens
gagaggataaagcagtcctgaagt

SEQ ID NO: 26573 - DNA, 24 bp, Homo sapiens
tgagaggataaagcagtcctgaag

SEQ ID NO: 26574 - DNA, 24 bp, Homo sapiens
tgtggaggcagccggtggttgagc

SEQ ID NO: 26575 - DNA, 24 bp, Homo sapiens
ctgtggaggcagccggtggttgag

SEQ ID NO: 26576 - DNA, 24 bp, Homo sapiens
cctgtggaggcagccggtggttga

SEQ ID NO: 26577 - DNA, 24 bp, Homo sapiens
tatttctataggaattatgttgga

SEQ ID NO: 26578 - DNA, 24 bp, Homo sapiens
ttatttctataggaattatgttgg

SEQ ID NO: 26579 - DNA, 24 bp, Homo sapiens
tttatttctataggaattatgttg

SEQ ID NO: 26580 - DNA, 24 bp, Homo sapiens
ttaaatcttagtgacaaaatcgcc

SEQ ID NO: 26581 - DNA, 24 bp, Homo sapiens
tttaaatcttagtgacaaaatcgc

SEQ ID NO: 26582 - DNA, 24 bp, Homo sapiens
ttttaaatcttagtgacaaaatcg

SEQ ID NO: 26583 - DNA, 24 bp, Homo sapiens
ataatttacaggtaccacttaatg

SEQ ID NO: 26584 - DNA, 24 bp, Homo sapiens
gataatttacaggtaccacttaat

SEQ ID NO: 26585 - DNA, 24 bp, Homo sapiens
agataatttacaggtaccacttaa

SEQ ID NO: 26586 - DNA, 24 bp, Homo sapiens
gacctgcctccagtagaacctgct

SEQ ID NO: 26587 - DNA, 24 bp, Homo sapiens
agtgctggctgctgagtctttgaa

SEQ ID NO: 26588 - DNA, 24 bp, Homo sapiens
gtgcgggaggacctcttccaggag

SEQ ID NO: 26589 - DNA, 24 bp, Homo sapiens
aaaattagctggttttgaaaacat

SEQ ID NO: 26590 - DNA, 24 bp, Homo sapiens
gaaaattagctggttttgaaaaca

SEQ ID NO: 26591 - DNA, 24 bp, Homo sapiens
ggaaaattagctggttttgaaaac

SEQ ID NO: 26592 - DNA, 24 bp, Homo sapiens
tggaaaatggagtagatatagttg

SEQ ID NO: 26593 - DNA, 24 bp, Homo sapiens
ttggaaaatggagtagatatagtt

SEQ ID NO: 26594 - DNA, 24 bp, Homo sapiens
tttggaaaatggagtagatatagt

SEQ ID NO: 26595 - DNA, 24 bp, Homo sapiens
actaattatagcaaatgtcatgga

SEQ ID NO: 26596 - DNA, 24 bp, Homo sapiens
tactaattatagcaaatgtcatgg

SEQ ID NO: 26597 - DNA, 24 bp, Homo sapiens
ttactaattatagcaaatgtcatg

SEQ ID NO: 26598 - DNA, 24 bp, Homo sapiens
gccaaccgcaaccattgacgccat

SEQ ID NO: 26599 - DNA, 24 bp, Homo sapiens
gatttggaggaagtagggcagggc

SEQ ID NO: 26600 - DNA, 24 bp, Homo sapiens
aagtggaatcttgatgagctgcct

SEQ ID NO: 26601 - DNA, 24 bp, Homo sapiens
agaagttcatgcttcagataaacc

SEQ ID NO: 26602 - DNA, 24 bp, Homo sapiens
cagaagttcatgcttcagataaac

SEQ ID NO: 26603 - DNA, 24 bp, Homo sapiens
acagaagttcatgcttcagataaa

SEQ ID NO: 26604 - DNA, 24 bp, Homo sapiens
ggattatatagagctgaaaaaaac

SEQ ID NO: 26605 - DNA, 24 bp, Homo sapiens
gggattatatagagctgaaaaaaa

SEQ ID NO: 26606 - DNA, 24 bp, Homo sapiens
ggggattatatagagctgaaaaaa

SEQ ID NO: 26607 - DNA, 24 bp, Homo sapiens
agagaatgatgatcaagttttatc

SEQ ID NO: 26608 - DNA, 24 bp, Homo sapiens
gagagaatgatgatcaagttttat

SEQ ID NO: 26609 - DNA, 24 bp, Homo sapiens
agagagaatgatgatcaagtttta

SEQ ID NO: 26610 - DNA, 24 bp, Homo sapiens
tcatagctaagccttttctaccct

SEQ ID NO: 26611 - DNA, 24 bp, Homo sapiens
ttcatagctaagccttttctaccc

SEQ ID NO: 26612 - DNA, 24 bp, Homo sapiens
tttcatagctaagccttttctacc

SEQ ID NO: 26613 - DNA, 24 bp, Homo sapiens
aattcatatagttggtccttgatg

SEQ ID NO: 26614 - DNA, 24 bp, Homo sapiens
aaattcatatagttggtccttgat

SEQ ID NO: 26615 - DNA, 24 bp, Homo sapiens
caaattcatatagttggtccttga

SEQ ID NO: 26616 - DNA, 24 bp, Homo sapiens
gcatagaaaaaagctgaaaaaaac

SEQ ID NO: 26617 - DNA, 24 bp, Homo sapiens
tgcatagaaaaaagctgaaaaaaa

SEQ ID NO: 26618 - DNA, 24 bp, Homo sapiens
atgcatagaaaaaagctgaaaaaa

SEQ ID NO: 26619 - DNA, 24 bp, Homo sapiens
cccagttcaagaatattttctgga

SEQ ID NO: 26620 - DNA, 24 bp, Homo sapiens
acccagttcaagaatattttctgg

SEQ ID NO: 26621 - DNA, 24 bp, Homo sapiens
tacccagttcaagaatattttctg

SEQ ID NO: 26622 - DNA, 23 bp, Homo sapiens
acagaaggttggtgccatccatt

SEQ ID NO: 26623 - DNA, 25 bp, Homo sapiens
aagacttcatggcagagctgtaccg

SEQ ID NO: 26624 - DNA, 25 bp, Homo sapiens
acagaagaagcgtgaagaagaggca

SEQ ID NO: 26625 - DNA, 24 bp, Homo sapiens
tctgtgcagcttatcaacgaccgc

SEQ ID NO: 26626 - DNA, 24 bp, Homo sapiens
aagaggaggaggcaggagaagcag

SEQ ID NO: 26627 - DNA, 23 bp, Homo sapiens
ccttctacaaccacgagcagatg

SEQ ID NO: 26628 - DNA, 24 bp, Homo sapiens
cagatttaaaggaaattgatgaag

SEQ ID NO: 26629 - DNA, 24 bp, Homo sapiens
tcagatttaaaggaaattgatgaa

SEQ ID NO: 26630 - DNA, 24 bp, Homo sapiens
atcagatttaaaggaaattgatga

SEQ ID NO: 26631 - DNA, 24 bp, Homo sapiens
cacttagattcagacgggctcggc

SEQ ID NO: 26632 - DNA, 25 bp, Homo sapiens
ctcacgcctgtaatcccagcacttt

SEQ ID NO: 26633 - DNA, 25 bp, Homo sapiens
acctgtggctagtttattgaagaag

SEQ ID NO: 26634 - DNA, 24 bp, Homo sapiens
atcttttctagaatcaacagttta

SEQ ID NO: 26635 - DNA, 24 bp, Homo sapiens
catcttttctagaatcaacagttt

SEQ ID NO: 26636 - DNA, 24 bp, Homo sapiens
ccatcttttctagaatcaacagtt

SEQ ID NO: 26637 - DNA, 24 bp, Homo sapiens
ctgtggtcgagggtttagtaactt

SEQ ID NO: 26638 - DNA, 24 bp, Homo sapiens
tctgtggtcgagggtttagtaact

SEQ ID NO: 26639 - DNA, 24 bp, Homo sapiens
atctgtggtcgagggtttagtaac

SEQ ID NO: 26640 - DNA, 24 bp, Homo sapiens
atttgaggaaggaaataatgattg

SEQ ID NO: 26641 - DNA, 24 bp, Homo sapiens
gatttgaggaaggaaataatgatt

SEQ ID NO: 26642 - DNA, 24 bp, Homo sapiens
agatttgaggaaggaaataatgat

SEQ ID NO: 26643 - DNA, 24 bp, Homo sapiens
ttttcttatagatctgaatatcct

SEQ ID NO: 26644 - DNA, 24 bp, Homo sapiens
cttttcttatagatctgaatatcc

SEQ ID NO: 26645 - DNA, 24 bp, Homo sapiens
gcttttcttatagatctgaatatc

SEQ ID NO: 26646 - DNA, 24 bp, Homo sapiens
gaagaactaaggtagaagaataca

SEQ ID NO: 26647 - DNA, 24 bp, Homo sapiens
tgaagaactaaggtagaagaatac

SEQ ID NO: 26648 - DNA, 24 bp, Homo sapiens
gtgaagaactaaggtagaagaata

SEQ ID NO: 26649 - DNA, 24 bp, Homo sapiens
tgttcctgctgtgggtcctcatca

SEQ ID NO: 26650 - DNA, 24 bp, Homo sapiens
gagtcctagtgccgtaccgtcagt

SEQ ID NO: 26651 - DNA, 23 bp, Homo sapiens
tccgttggagtcgtctctgccgc

SEQ ID NO: 26652 - DNA, 24 bp, Homo sapiens
ggcgagctgctggacttctcactg

SEQ ID NO: 26653 - DNA, 24 bp, Homo sapiens
tgaaccaggagtttctgaccacgc

SEQ ID NO: 26654 - DNA, 24 bp, Homo sapiens
cgccaggtggaggtgctcactaac

SEQ ID NO: 26655 - DNA, 24 bp, Homo sapiens
aagaaaaaatggacttgcaatctc

SEQ ID NO: 26656 - DNA, 24 bp, Homo sapiens
taagaaaaaatggacttgcaatct

SEQ ID NO: 26657 - DNA, 24 bp, Homo sapiens
ttaagaaaaaatggacttgcaatc

SEQ ID NO: 26658 - DNA, 24 bp, Homo sapiens
cattttaacagtttcaggctttta

SEQ ID NO: 26659 - DNA, 24 bp, Homo sapiens
tcattttaacagtttcaggctttt

SEQ ID NO: 26660 - DNA, 24 bp, Homo sapiens
atcattttaacagtttcaggcttt

SEQ ID NO: 26661 - DNA, 24 bp, Homo sapiens
aaatggacaaaacaactaagaaaa

SEQ ID NO: 26662 - DNA, 24 bp, Homo sapiens
gaaatggacaaaacaactaagaaa

SEQ ID NO: 26663 - DNA, 24 bp, Homo sapiens
ggaaatggacaaaacaactaagaa

SEQ ID NO: 26664 - DNA, 23 bp, Homo sapiens
acagccagcccgccctctcctgc

SEQ ID NO: 26665 - DNA, 23 bp, Homo sapiens
cttcctctcctctctcttcttgc

SEQ ID NO: 26666 - DNA, 23 bp, Homo sapiens
tgcagctctgacttgctttttcc

SEQ ID NO: 26667 - DNA, 24 bp, Homo sapiens
agaaaataaaagtaagttttttgt

SEQ ID NO: 26668 - DNA, 24 bp, Homo sapiens
aagaaaataaaagtaagttttttg

SEQ ID NO: 26669 - DNA, 24 bp, Homo sapiens
gaagaaaataaaagtaagtttttt

SEQ ID NO: 26670 - DNA, 23 bp, Homo sapiens
tcctgagactgctgtgctgtgcg

SEQ ID NO: 26671 - DNA, 23 bp, Homo sapiens
ggaccgcagacagcacattctct

SEQ ID NO: 26672 - DNA, 23 bp, Homo sapiens
ccaggttccatcacaggcggctg

SEQ ID NO: 26673 - DNA, 25 bp, Homo sapiens
tgaactccagcagtgtccatgaaga

SEQ ID NO: 26674 - DNA, 25 bp, Homo sapiens
tctcagactcaagtgggtgacagcc

SEQ ID NO: 26675 - DNA, 25 bp, Homo sapiens
ttgccacagacacagacattacatt

SEQ ID NO: 26676 - DNA, 25 bp, Homo sapiens
tctcagactcaagtgggtgacagcc

SEQ ID NO: 26677 - DNA, 25 bp, Homo sapiens
ttgccacagacacagacattacatt

SEQ ID NO: 26678 - DNA, 25 bp, Homo sapiens
ccaccagtgaggacaacttcaagaa

SEQ ID NO: 26679 - DNA, 24 bp, Homo sapiens
cttctgattagggcaaaattctca

SEQ ID NO: 26680 - DNA, 24 bp, Homo sapiens
tcttctgattagggcaaaattctc

SEQ ID NO: 26681 - DNA, 24 bp, Homo sapiens
ttcttctgattagggcaaaattct

SEQ ID NO: 26682 - DNA, 23 bp, Homo sapiens
gtgctgcgtcttgctgctactca

SEQ ID NO: 26683 - DNA, 23 bp, Homo sapiens
ggtgacgatgctctggttctccg

SEQ ID NO: 26684 - DNA, 23 bp, Homo sapiens
cgttactgccgccgctcgcctgg

SEQ ID NO: 26685 - DNA, 24 bp, Homo sapiens
aggctggagtacagtggcacgatc

SEQ ID NO: 26686 - DNA, 24 bp, Homo sapiens
aggaagcaggatctcaccagacat

SEQ ID NO: 26687 - DNA, 24 bp, Homo sapiens
gcctcgttaagaacagaatgctct

SEQ ID NO: 26688 - DNA, 23 bp, Homo sapiens
cctgccttccttccttccgcccg

SEQ ID NO: 26689 - DNA, 23 bp, Homo sapiens
ttcctcctgtcaactgcctccgc

SEQ ID NO: 26690 - DNA, 23 bp, Homo sapiens
cctaaagcctgagggaccgttgc

SEQ ID NO: 26691 - DNA, 24 bp, Homo sapiens
ttaaagaaatttggttgcaaatga

SEQ ID NO: 26692 - DNA, 24 bp, Homo sapiens
cttaaagaaatttggttgcaaatg

SEQ ID NO: 26693 - DNA, 24 bp, Homo sapiens
tcttaaagaaatttggttgcaaat

SEQ ID NO: 26694 - DNA, 24 bp, Homo sapiens
tttcattgtaggaatcactatctt

SEQ ID NO: 26695 - DNA, 24 bp, Homo sapiens
ttttcattgtaggaatcactatct

SEQ ID NO: 26696 - DNA, 24 bp, Homo sapiens
gttttcattgtaggaatcactatc

SEQ ID NO: 26697 - DNA, 24 bp, Homo sapiens
aacaacaacgacaacaacagccgc

SEQ ID NO: 26698 - DNA, 25 bp, Homo sapiens
gtgctgctttgcttccaaaactggg

SEQ ID NO: 26699 - DNA, 23 bp, Homo sapiens
tcctggccgtcatggagtttctt

SEQ ID NO: 26700 - DNA, 25 bp, Homo sapiens
aatgagtacgcctatgccaagtgga

SEQ ID NO: 26701 - DNA, 23 bp, Homo sapiens
gctggagtcaggaggcatgtacc

SEQ ID NO: 26702 - DNA, 25 bp, Homo sapiens
cggtgaataaagatcagtgtcccag

SEQ ID NO: 26703 - DNA, 24 bp, Homo sapiens
cctgccacccttcccaccaaagta

SEQ ID NO: 26704 - DNA, 25 bp, Homo sapiens
tgagaggagggaccaactggaacaa

SEQ ID NO: 26705 - DNA, 25 bp, Homo sapiens
gctgaatacatttgacatcgccacc

SEQ ID NO: 26706 - DNA, 25 bp, Homo sapiens
ttaacagtgattgcctcttccttgt

SEQ ID NO: 26707 - DNA, 23 bp, Homo sapiens
gtgcagtggtgtgatctcggctc

SEQ ID NO: 26708 - DNA, 25 bp, Homo sapiens
tctcttggtggtcatcaataactga

SEQ ID NO: 26709 - DNA, 23 bp, Homo sapiens
ggattacagatgtgagccgccgc

SEQ ID NO: 26710 - DNA, 25 bp, Homo sapiens
tgctgactcttatggttagtgcctt

SEQ ID NO: 26711 - DNA, 23 bp, Homo sapiens
tgcccaccaccacacccactaat

SEQ ID NO: 26712 - DNA, 24 bp, Homo sapiens
tcttggccaagatttctggaatat

SEQ ID NO: 26713 - DNA, 24 bp, Homo sapiens
gtcttggccaagatttctggaata

SEQ ID NO: 26714 - DNA, 24 bp, Homo sapiens
tgtcttggccaagatttctggaat

SEQ ID NO: 26715 - DNA, 24 bp, Homo sapiens
cctctattcagctcccattttctc

SEQ ID NO: 26716 - DNA, 24 bp, Homo sapiens
acctctattcagctcccattttct

SEQ ID NO: 26717 - DNA, 24 bp, Homo sapiens
gacctctattcagctcccattttc

SEQ ID NO: 26718 - DNA, 24 bp, Homo sapiens
gcgacgaaccttggagagaggaga

SEQ ID NO: 26719 - DNA, 23 bp, Homo sapiens
ggaggtgatgctggagaactaca

SEQ ID NO: 26720 - DNA, 25 bp, Homo sapiens
tgacaaccaggaaggaggcattgat

SEQ ID NO: 26721 - DNA, 24 bp, Homo sapiens
actagctggagtttttctggttgg

SEQ ID NO: 26722 - DNA, 24 bp, Homo sapiens
cactagctggagtttttctggttg

SEQ ID NO: 26723 - DNA, 24 bp, Homo sapiens
tcactagctggagtttttctggtt

SEQ ID NO: 26724 - DNA, 24 bp, Homo sapiens
acacctagaaggtaagaagttatt

SEQ ID NO: 26725 - DNA, 24 bp, Homo sapiens
aacacctagaaggtaagaagttat

SEQ ID NO: 26726 - DNA, 24 bp, Homo sapiens
aaacacctagaaggtaagaagtta

SEQ ID NO: 26727 - DNA, 24 bp, Homo sapiens
attttttacaggttctcaaaggac

SEQ ID NO: 26728 - DNA, 24 bp, Homo sapiens
gattttttacaggttctcaaagga

SEQ ID NO: 26729 - DNA, 24 bp, Homo sapiens
tgattttttacaggttctcaaagg

SEQ ID NO: 26730 - DNA, 24 bp, Homo sapiens
ttttctgaaaagtaagtaattttt

SEQ ID NO: 26731 - DNA, 24 bp, Homo sapiens
gttttctgaaaagtaagtaatttt

SEQ ID NO: 26732 - DNA, 24 bp, Homo sapiens
agttttctgaaaagtaagtaattt

SEQ ID NO: 26733 - DNA, 24 bp, Homo sapiens
actttcagatgctaaccaaaccgc

SEQ ID NO: 26734 - DNA, 24 bp, Homo sapiens
aagataagcaaacttgactgggcg

SEQ ID NO: 26735 - DNA, 24 bp, Homo sapiens
gatgtcaggagttcaagaccagcc

SEQ ID NO: 26736 - DNA, 24 bp, Homo sapiens
ctcacggtcagcccttcatgtcac

SEQ ID NO: 26737 - DNA, 24 bp, Homo sapiens
cctcacggtcagcccttcatgtca

SEQ ID NO: 26738 - DNA, 24 bp, Homo sapiens
gcctcacggtcagcccttcatgtc

SEQ ID NO: 26739 - DNA, 23 bp, Homo sapiens
gcgcggacgatgcctgccgtgcc

SEQ ID NO: 26740 - DNA, 23 bp, Homo sapiens
ctggagccgccgctgccgccgcc

SEQ ID NO: 26741 - DNA, 23 bp, Homo sapiens
gcgtttcccggaacagcccgcgc

SEQ ID NO: 26742 - DNA, 23 bp, Homo sapiens
cggcggcgtggagcagcatgtac

SEQ ID NO: 26743 - DNA, 23 bp, Homo sapiens
caagggttcggccgtgccctccg

SEQ ID NO: 26744 - DNA, 24 bp, Homo sapiens
gaaaaaataaggtattctgcaagt

SEQ ID NO: 26745 - DNA, 24 bp, Homo sapiens
tgaaaaaataaggtattctgcaag

SEQ ID NO: 26746 - DNA, 24 bp, Homo sapiens
ttgaaaaaataaggtattctgcaa

SEQ ID NO: 26747 - DNA, 25 bp, Homo sapiens
tctcgcaaagtcatccaaacccagg

SEQ ID NO: 26748 - DNA, 25 bp, Homo sapiens
agcatctgtaacctggacatcttct

SEQ ID NO: 26749 - DNA, 24 bp, Homo sapiens
catggatgtggatcagacgccttc

SEQ ID NO: 26750 - DNA, 24 bp, Homo sapiens
aagatgaacagccaggactggtga

SEQ ID NO: 26751 - DNA, 24 bp, Homo sapiens
gaagatgaacagccaggactggtg

SEQ ID NO: 26752 - DNA, 24 bp, Homo sapiens
agaagatgaacagccaggactggt

SEQ ID NO: 26753 - DNA, 24 bp, Homo sapiens
tgcacttgatggtgttgttatttc

SEQ ID NO: 26754 - DNA, 24 bp, Homo sapiens
ctgcacttgatggtgttgttattt

SEQ ID NO: 26755 - DNA, 24 bp, Homo sapiens
gctgcacttgatggtgttgttatt

SEQ ID NO: 26756 - DNA, 24 bp, Homo sapiens
ggttctaacaggtatacaatatgt

SEQ ID NO: 26757 - DNA, 24 bp, Homo sapiens
aggttctaacaggtatacaatatg

SEQ ID NO: 26758 - DNA, 24 bp, Homo sapiens
aaggttctaacaggtatacaatat

SEQ ID NO: 26759 - DNA, 25 bp, Homo sapiens
cgtggttgtggtgagcctaattctt

SEQ ID NO: 26760 - DNA, 25 bp, Homo sapiens
tcaaccatcatgcagaccagtctct

SEQ ID NO: 26761 - DNA, 25 bp, Homo sapiens
ggaagaatgaaccatgtgacactct

SEQ ID NO: 26762 - DNA, 24 bp, Homo sapiens
aaattcctcaggatatttgcaaat

SEQ ID NO: 26763 - DNA, 24 bp, Homo sapiens
gaaattcctcaggatatttgcaaa

SEQ ID NO: 26764 - DNA, 24 bp, Homo sapiens
agaaattcctcaggatatttgcaa

SEQ ID NO: 26765 - DNA, 24 bp, Homo sapiens
gctggaattacaggcatgagccac

SEQ ID NO: 26766 - DNA, 24 bp, Homo sapiens
cggctgttagtgaattcttattca

SEQ ID NO: 26767 - DNA, 24 bp, Homo sapiens
acaaacaatccaattctacacttt

SEQ ID NO: 26768 - DNA, 24 bp, Homo sapiens
accacagtgttatttttatcgtca

SEQ ID NO: 26769 - DNA, 24 bp, Homo sapiens
atacgagtataaatgaaattcatt

SEQ ID NO: 26770 - DNA, 24 bp, Homo sapiens
aggtgatgatagctcatggcagca

SEQ ID NO: 26771 - DNA, 24 bp, Homo sapiens
gctggtggctgtctctcctgctca

SEQ ID NO: 26772 - DNA, 24 bp, Homo sapiens
cagacctgtgccgtctcctactgc

SEQ ID NO: 26773 - DNA, 25 bp, Homo sapiens
gctgcccgagatgaatgacccttat

SEQ ID NO: 26774 - DNA, 23 bp, Homo sapiens
gtggtggtggaggtggcagtgtg

SEQ ID NO: 26775 - DNA, 25 bp, Homo sapiens
tgtgccgtctacaggactgatgact

SEQ ID NO: 26776 - DNA, 24 bp, Homo sapiens
gataccgatgtcttcctggcgtgc

SEQ ID NO: 26777 - DNA, 24 bp, Homo sapiens
cagccttgacgcagaagaacttga

SEQ ID NO: 26778 - DNA, 24 bp, Homo sapiens
gcatagcaagtagtaggcaggagg

SEQ ID NO: 26779 - DNA, 24 bp, Homo sapiens
ggtggcggcagcagttctcaaggc

SEQ ID NO: 26780 - DNA, 24 bp, Homo sapiens
gggtggcggcagcagttctcaagg

SEQ ID NO: 26781 - DNA, 24 bp, Homo sapiens
tgggtggcggcagcagttctcaag

SEQ ID NO: 26782 - DNA, 23 bp, Homo sapiens
agagccctgccctgaccaccctg

SEQ ID NO: 26783 - DNA, 23 bp, Homo sapiens
agggctccagtacctggtgggta

SEQ ID NO: 26784 - DNA, 23 bp, Homo sapiens
gacctacctgtgtgcagtcctgc

SEQ ID NO: 26785 - DNA, 24 bp, Homo sapiens
gcctggacactgcacagcggaatt

SEQ ID NO: 26786 - DNA, 24 bp, Homo sapiens
gcagaaattgagagatccacagct

SEQ ID NO: 26787 - DNA, 24 bp, Homo sapiens
gcagacaagatggcttccgggatt

SEQ ID NO: 26788 - DNA, 25 bp, Homo sapiens
aagaatacatcgcagagaagcagaa

SEQ ID NO: 26789 - DNA, 23 bp, Homo sapiens
agcagaagaagcagaagccgcag

SEQ ID NO: 26790 - DNA, 23 bp, Homo sapiens
cgcagcagcagcagcagaagtaa

SEQ ID NO: 26791 - DNA, 24 bp, Homo sapiens
ttggcgtggtgatgggcactgtgc

SEQ ID NO: 26792 - DNA, 24 bp, Homo sapiens
tttggcgtggtgatgggcactgtg

SEQ ID NO: 26793 - DNA, 24 bp, Homo sapiens
gtttggcgtggtgatgggcactgt

SEQ ID NO: 26794 - DNA, 24 bp, Homo sapiens
attgaatacatgtgagttgtgcta

SEQ ID NO: 26795 - DNA, 24 bp, Homo sapiens
tattgaatacatgtgagttgtgct

SEQ ID NO: 26796 - DNA, 24 bp, Homo sapiens
atattgaatacatgtgagttgtgc

SEQ ID NO: 26797 - DNA, 24 bp, Homo sapiens
tgaataataagtctagataaactt

SEQ ID NO: 26798 - DNA, 24 bp, Homo sapiens
atgaataataagtctagataaact

SEQ ID NO: 26799 - DNA, 24 bp, Homo sapiens
tatgaataataagtctagataaac

SEQ ID NO: 26800 - DNA, 24 bp, Homo sapiens
caatgttaccatgatatgaatgaa

SEQ ID NO: 26801 - DNA, 24 bp, Homo sapiens
acaatgttaccatgatatgaatga

SEQ ID NO: 26802 - DNA, 24 bp, Homo sapiens
aacaatgttaccatgatatgaatg

SEQ ID NO: 26803 - DNA, 24 bp, Homo sapiens
ggctttaataggtgggaattaaaa

SEQ ID NO: 26804 - DNA, 24 bp, Homo sapiens
aggctttaataggtgggaattaaa

SEQ ID NO: 26805 - DNA, 24 bp, Homo sapiens
caggctttaataggtgggaattaa

SEQ ID NO: 26806 - DNA, 24 bp, Homo sapiens
caccaacttacgttttcattaata

SEQ ID NO: 26807 - DNA, 24 bp, Homo sapiens
acaccaacttacgttttcattaat

SEQ ID NO: 26808 - DNA, 24 bp, Homo sapiens
aacaccaacttacgttttcattaa

SEQ ID NO: 26809 - DNA, 24 bp, Homo sapiens
gttgagaagaaagaacgagcccga

SEQ ID NO: 26810 - DNA, 24 bp, Homo sapiens
ccagatggtgagagcgatgaggtc

SEQ ID NO: 26811 - DNA, 24 bp, Homo sapiens
cgaactagccagaagcgatccctc

SEQ ID NO: 26812 - DNA, 24 bp, Homo sapiens
atgaagcaagagtaagaaactgtt

SEQ ID NO: 26813 - DNA, 24 bp, Homo sapiens
gatgaagcaagagtaagaaactgt

SEQ ID NO: 26814 - DNA, 24 bp, Homo sapiens
cgatgaagcaagagtaagaaactg

SEQ ID NO: 26815 - DNA, 24 bp, Homo sapiens
ttgttgacgacgactacaccaggc

SEQ ID NO: 26816 - DNA, 24 bp, Homo sapiens
gcctgctacctgactctgagatga

SEQ ID NO: 26817 - DNA, 24 bp, Homo sapiens
ccaacatagcaccgcaactcgtca

SEQ ID NO: 26818 - DNA, 24 bp, Homo sapiens
ggccttgctggacatcctggacta

SEQ ID NO: 26819 - DNA, 24 bp, Homo sapiens
aggccttgctggacatcctggact

SEQ ID NO: 26820 - DNA, 24 bp, Homo sapiens
caggccttgctggacatcctggac

SEQ ID NO: 26821 - DNA, 24 bp, Homo sapiens
tgacagcaccagtaagtccccttg

SEQ ID NO: 26822 - DNA, 24 bp, Homo sapiens
atgacagcaccagtaagtcccctt

SEQ ID NO: 26823 - DNA, 24 bp, Homo sapiens
aatgacagcaccagtaagtcccct

SEQ ID NO: 26824 - DNA, 24 bp, Homo sapiens
acctggaatggatactacgagtgt

SEQ ID NO: 26825 - DNA, 24 bp, Homo sapiens
agcaggcagacaatgacaccatcg

SEQ ID NO: 26826 - DNA, 24 bp, Homo sapiens
ggtggcatcatcaagaggaggaca

SEQ ID NO: 26827 - DNA, 24 bp, Homo sapiens
acacagattattcctgcggaggct

SEQ ID NO: 26828 - DNA, 24 bp, Homo sapiens
atgctggtgtcatctgctcaggaa

SEQ ID NO: 26829 - DNA, 24 bp, Homo sapiens
cgaggctggttctcccacaactgt

SEQ ID NO: 26830 - DNA, 24 bp, Homo sapiens
tgaggctggtgaatggaggtgaca

SEQ ID NO: 26831 - DNA, 24 bp, Homo sapiens
accaatgatgccaatgtcgtctgc

SEQ ID NO: 26832 - DNA, 24 bp, Homo sapiens
cgctgctcaggacacgagtcttac

SEQ ID NO: 26833 - DNA, 24 bp, Homo sapiens
aacaacataaggtaggtgtatctt

SEQ ID NO: 26834 - DNA, 24 bp, Homo sapiens
caacaacataaggtaggtgtatct

SEQ ID NO: 26835 - DNA, 24 bp, Homo sapiens
acaacaacataaggtaggtgtatc

SEQ ID NO: 26836 - DNA, 24 bp, Homo sapiens
ataaagatatggtaaattggttgt

SEQ ID NO: 26837 - DNA, 24 bp, Homo sapiens
aataaagatatggtaaattggttg

SEQ ID NO: 26838 - DNA, 24 bp, Homo sapiens
caataaagatatggtaaattggtt

SEQ ID NO: 26839 - DNA, 24 bp, Homo sapiens
tcaagcagaaggtatgagaaaaaa

SEQ ID NO: 26840 - DNA, 24 bp, Homo sapiens
atcaagcagaaggtatgagaaaaa

SEQ ID NO: 26841 - DNA, 24 bp, Homo sapiens
catcaagcagaaggtatgagaaaa

SEQ ID NO: 26842 - DNA, 23 bp, Homo sapiens
cctgagccagcctcgtagtcctg

SEQ ID NO: 26843 - DNA, 25 bp, Homo sapiens
aaagcagcagcacgaacataaaggc

SEQ ID NO: 26844 - DNA, 25 bp, Homo sapiens
cctcctgaaatgatgcccacctctc

SEQ ID NO: 26845 - DNA, 24 bp, Homo sapiens
cagtgacccagaagacggaagcat

SEQ ID NO: 26846 - DNA, 25 bp, Homo sapiens
tgtcaccaccactcagccatcacta

SEQ ID NO: 26847 - DNA, 25 bp, Homo sapiens
aacagtaactacggtgaccacaagg

SEQ ID NO: 26848 - DNA, 25 bp, Homo sapiens
gtggcagacaaatgtagatgtggca

SEQ ID NO: 26849 - DNA, 25 bp, Homo sapiens
gcgagaggctgctttggaagaaact

SEQ ID NO: 26850 - DNA, 25 bp, Homo sapiens
aggatgctacccgtaaggaaaggct

SEQ ID NO: 26851 - DNA, 24 bp, Homo sapiens
agtcctacgccaagaactactccg

SEQ ID NO: 26852 - DNA, 24 bp, Homo sapiens
cttccatcactcgctcacggacca

SEQ ID NO: 26853 - DNA, 24 bp, Homo sapiens
gaatgatgctgggtggtggctgtg

SEQ ID NO: 26854 - DNA, 24 bp, Homo sapiens
caagtaccagggccactgttaccg

SEQ ID NO: 26855 - DNA, 23 bp, Homo sapiens
gcgagacctgggtggatgctgag

SEQ ID NO: 26856 - DNA, 23 bp, Homo sapiens
tgtcgggagcagcagtcacacct

SEQ ID NO: 26857 - DNA, 23 bp, Homo sapiens
catgcgtgggtgacaaggacagc

SEQ ID NO: 26858 - DNA, 24 bp, Homo sapiens
cagagacctacgatgtctactgct

SEQ ID NO: 26859 - DNA, 23 bp, Homo sapiens
ggtcaggacctatggcgtgcgcc

SEQ ID NO: 26860 - DNA, 24 bp, Homo sapiens
ctgccagttcacaaccgctccgag

SEQ ID NO: 26861 - DNA, 24 bp, Homo sapiens
cgctccctgaaccctagaactgtc

SEQ ID NO: 26862 - DNA, 24 bp, Homo sapiens
ccgcccagctccagtcctgtgatc

SEQ ID NO: 26863 - DNA, 24 bp, Homo sapiens
cctaccttagttctgttcttccac

SEQ ID NO: 26864 - DNA, 24 bp, Homo sapiens
ctcatcgtgggtatgcctgggaca

SEQ ID NO: 26865 - DNA, 24 bp, Homo sapiens
gctatacacactctgctgttgaca

SEQ ID NO: 26866 - DNA, 24 bp, Homo sapiens
cgaagactgactgtgattataaca

SEQ ID NO: 26867 - DNA, 24 bp, Homo sapiens
ccgaagactgactgtgattataac

SEQ ID NO: 26868 - DNA, 24 bp, Homo sapiens
tccgaagactgactgtgattataa

SEQ ID NO: 26869 - DNA, 24 bp, Homo sapiens
gacgcccaaatcatacctctcctt

SEQ ID NO: 26870 - DNA, 24 bp, Homo sapiens
gggtggctgagaagtgtgttgatt

SEQ ID NO: 26871 - DNA, 24 bp, Homo sapiens
atcaagaaggaggtggtccaatgc

SEQ ID NO: 26872 - DNA, 24 bp, Homo sapiens
agctgctgaaggaagcggatgacg

SEQ ID NO: 26873 - DNA, 24 bp, Homo sapiens
gatgtgaaggctgtgctggcagtg

SEQ ID NO: 26874 - DNA, 24 bp, Homo sapiens
ctgctgaagacttggcgggagatg

SEQ ID NO: 26875 - DNA, 24 bp, Homo sapiens
taaaatctcagcaaagactgaagg

SEQ ID NO: 26876 - DNA, 24 bp, Homo sapiens
ataaaatctcagcaaagactgaag

SEQ ID NO: 26877 - DNA, 24 bp, Homo sapiens
gataaaatctcagcaaagactgaa

SEQ ID NO: 26878 - DNA, 24 bp, Homo sapiens
aaatgacaaagcaaaaagagaaga

SEQ ID NO: 26879 - DNA, 24 bp, Homo sapiens
caaatgacaaagcaaaaagagaag

SEQ ID NO: 26880 - DNA, 24 bp, Homo sapiens
ccaaatgacaaagcaaaaagagaa

SEQ ID NO: 26881 - DNA, 24 bp, Homo sapiens
ggaagaccacctgcatccacacct

SEQ ID NO: 26882 - DNA, 24 bp, Homo sapiens
tcaaccatcctccttggaaactga

SEQ ID NO: 26883 - DNA, 24 bp, Homo sapiens
ccagctattcgaaacgcagagagt

SEQ ID NO: 26884 - DNA, 24 bp, Homo sapiens
agatatttcaggccagtttcgatg

SEQ ID NO: 26885 - DNA, 24 bp, Homo sapiens
cagatatttcaggccagtttcgat

SEQ ID NO: 26886 - DNA, 24 bp, Homo sapiens
acagatatttcaggccagtttcga

SEQ ID NO: 26887 - DNA, 24 bp, Homo sapiens
atttttagatggtaagtataaaat

SEQ ID NO: 26888 - DNA, 24 bp, Homo sapiens
catttttagatggtaagtataaaa

SEQ ID NO: 26889 - DNA, 24 bp, Homo sapiens
tcatttttagatggtaagtataaa

SEQ ID NO: 26890 - DNA, 24 bp, Homo sapiens
tttctgttgtcaaatatgcttcag

SEQ ID NO: 26891 - DNA, 24 bp, Homo sapiens
cgtttttcctttgaaaattacatt

SEQ ID NO: 26892 - DNA, 24 bp, Homo sapiens
tccaaagaagaaggcggtgtttcc

SEQ ID NO: 26893 - DNA, 24 bp, Homo sapiens
cggcagcatgaaagcaagttggac

SEQ ID NO: 26894 - DNA, 24 bp, Homo sapiens
ttgggagcactggaataagaaact

SEQ ID NO: 26895 - DNA, 24 bp, Homo sapiens
tggaagagcaggtatgaagatctg

SEQ ID NO: 26896 - DNA, 24 bp, Homo sapiens
ctggaagagcaggtatgaagatct

SEQ ID NO: 26897 - DNA, 24 bp, Homo sapiens
tctggaagagcaggtatgaagatc

SEQ ID NO: 26898 - DNA, 23 bp, Homo sapiens
atctccgcctcagagcagcagag

SEQ ID NO: 26899 - DNA, 23 bp, Homo sapiens
cagcagcagccatgttctcctcc

SEQ ID NO: 26900 - DNA, 25 bp, Homo sapiens
ccagagacgaaggagatcactatca

SEQ ID NO: 26901 - DNA, 23 bp, Homo sapiens
ccgaacgcagagattggcttcct

SEQ ID NO: 26902 - DNA, 23 bp, Homo sapiens
ggacagccaggccagagacggag

SEQ ID NO: 26903 - DNA, 23 bp, Homo sapiens
aagctcttccgcactgtgctgga

SEQ ID NO: 26904 - DNA, 24 bp, Homo sapiens
gctactcggaggctgaggcaggaa

SEQ ID NO: 26905 - DNA, 24 bp, Homo sapiens
cagggactcaagtggtgtcaatga

SEQ ID NO: 26906 - DNA, 24 bp, Homo sapiens
ccgataccagtatcctgaggagag

SEQ ID NO: 26907 - DNA, 24 bp, Homo sapiens
tgcctatgacaggatcgtggttgc

SEQ ID NO: 26908 - DNA, 24 bp, Homo sapiens
ctcggctcttccctttaacttcca

SEQ ID NO: 26909 - DNA, 24 bp, Homo sapiens
cagtggaggtgatgctgaagtgag

SEQ ID NO: 26910 - DNA, 24 bp, Homo sapiens
ttgttttctagaaattcaaggaga

SEQ ID NO: 26911 - DNA, 24 bp, Homo sapiens
tttgttttctagaaattcaaggag

SEQ ID NO: 26912 - DNA, 24 bp, Homo sapiens
ctttgttttctagaaattcaagga

SEQ ID NO: 26913 - DNA, 24 bp, Homo sapiens
cagcagggacttactgaccaggac

SEQ ID NO: 26914 - DNA, 24 bp, Homo sapiens
ttgagactttgaggggatctgatt

SEQ ID NO: 26915 - DNA, 24 bp, Homo sapiens
gcacaatcaaggacagtattccca

SEQ ID NO: 26916 - DNA, 24 bp, Homo sapiens
aaaaagacatggaaaggctataaa

SEQ ID NO: 26917 - DNA, 24 bp, Homo sapiens
taaaaagacatggaaaggctataa

SEQ ID NO: 26918 - DNA, 24 bp, Homo sapiens
gtaaaaagacatggaaaggctata

SEQ ID NO: 26919 - DNA, 24 bp, Homo sapiens
ctattgctgaactttgttcagaat

SEQ ID NO: 26920 - DNA, 24 bp, Homo sapiens
actattgctgaactttgttcagaa

SEQ ID NO: 26921 - DNA, 24 bp, Homo sapiens
aactattgctgaactttgttcaga

SEQ ID NO: 26922 - DNA, 24 bp, Homo sapiens
aacagcagatccttcattcagagg

SEQ ID NO: 26923 - DNA, 24 bp, Homo sapiens
tgaaagagccctggctgaagattc

SEQ ID NO: 26924 - DNA, 24 bp, Homo sapiens
catcttttttgaccggacaatacg

SEQ ID NO: 26925 - DNA, 24 bp, Homo sapiens
ttctctttcagaataacaagcctt

SEQ ID NO: 26926 - DNA, 24 bp, Homo sapiens
tttctctttcagaataacaagcct

SEQ ID NO: 26927 - DNA, 24 bp, Homo sapiens
ttttctctttcagaataacaagcc

SEQ ID NO: 26928 - DNA, 24 bp, Homo sapiens
aaaaaaaagaagtatgtttgattt

SEQ ID NO: 26929 - DNA, 24 bp, Homo sapiens
aaaaaaaaagaagtatgtttgatt

SEQ ID NO: 26930 - DNA, 24 bp, Homo sapiens
aaaaaaaaagaagtatgtttgatt

SEQ ID NO: 26931 - DNA, 24 bp, Homo sapiens
gcgtggtggtggatgacaagaagt

SEQ ID NO: 26932 - DNA, 24 bp, Homo sapiens
gaccatcacggtgcgagacacgat

SEQ ID NO: 26933 - DNA, 24 bp, Homo sapiens
gaatggagcctcggcactggagat

SEQ ID NO: 26934 - DNA, 25 bp, Homo sapiens
tcctccagagttcggatttcctgag

SEQ ID NO: 26935 - DNA, 25 bp, Homo sapiens
cgcctacttggaaatagtctcaacg

SEQ ID NO: 26936 - DNA, 25 bp, Homo sapiens
cagaggatgtgcaggttgagaatat

SEQ ID NO: 26937 - DNA, 24 bp, Homo sapiens
tcagagccgagaacaaatggcttc

SEQ ID NO: 26938 - DNA, 24 bp, Homo sapiens
atcagagccgagaacaaatggctt

SEQ ID NO: 26939 - DNA, 24 bp, Homo sapiens
gatcagagccgagaacaaatggct

SEQ ID NO: 26940 - DNA, 25 bp, Homo sapiens
cccaagtaaacctagctcggcgatc

SEQ ID NO: 26941 - DNA, 23 bp, Homo sapiens
cctcccgccagccagccccgacc

SEQ ID NO: 26942 - DNA, 23 bp, Homo sapiens
cgagcccagcgccctgcacggcc

SEQ ID NO: 26943 - DNA, 23 bp, Homo sapiens
gtgtggagtgcctggaggtgctg

SEQ ID NO: 26944 - DNA, 25 bp, Homo sapiens
gatgacgatggctatcagtcttact

SEQ ID NO: 26945 - DNA, 23 bp, Homo sapiens
tgtccttccaccctctctttgag

SEQ ID NO: 26946 - DNA, 25 bp, Homo sapiens
gagaagtggttcaggatgggtttca

SEQ ID NO: 26947 - DNA, 23 bp, Homo sapiens
gtgtgaccagggcagaagcagag

SEQ ID NO: 26948 - DNA, 24 bp, Homo sapiens
gaggctgtctgggcatttcttccg

SEQ ID NO: 26949 - DNA, 24 bp, Homo sapiens
tacttgagtctgccctccacgaag

SEQ ID NO: 26950 - DNA, 24 bp, Homo sapiens
cgtgtgctccaccaaactgactca

SEQ ID NO: 26951 - DNA, 24 bp, Homo sapiens
cgatggtggtgaagtagtgaagtt

SEQ ID NO: 26952 - DNA, 24 bp, Homo sapiens
gtggtacaaccttggtcaacacaa

SEQ ID NO: 26953 - DNA, 24 bp, Homo sapiens
aaggaggcagaggagacgaacagt

SEQ ID NO: 26954 - DNA, 24 bp, Homo sapiens
gcaggaagcacaaatacctcgcca

SEQ ID NO: 26955 - DNA, 24 bp, Homo sapiens
aaaatgtgaaggttggtacagagg

SEQ ID NO: 26956 - DNA, 24 bp, Homo sapiens
aaaaatgtgaaggttggtacagag

SEQ ID NO: 26957 - DNA, 24 bp, Homo sapiens
gaaaaatgtgaaggttggtacaga

SEQ ID NO: 26958 - DNA, 24 bp, Homo sapiens
ctttcgggtcggcttctatggcag

SEQ ID NO: 26959 - DNA, 24 bp, Homo sapiens
acaacattatggagcagcaacgcc

SEQ ID NO: 26960 - DNA, 24 bp, Homo sapiens
cagacagagtggcagcggaaggag

SEQ ID NO: 26961 - DNA, 24 bp, Homo sapiens
ggattcttggcagcatcttctcca

SEQ ID NO: 26962 - DNA, 24 bp, Homo sapiens
gtggttctccatcacattcacctt

SEQ ID NO: 26963 - DNA, 24 bp, Homo sapiens
aggcagcagaaagagctgctaatt

SEQ ID NO: 26964 - DNA, 24 bp, Homo sapiens
gagtgaagtggagacaccgaacgc

SEQ ID NO: 26965 - DNA, 24 bp, Homo sapiens
aactgctgacgacaccgtatgagc

SEQ ID NO: 26966 - DNA, 24 bp, Homo sapiens
acctgctgtgctggctcctggaac

SEQ ID NO: 26967 - DNA, 24 bp, Homo sapiens
ctgcttctccctggatgctcaacg

SEQ ID NO: 26968 - DNA, 24 bp, Homo sapiens
cccaactttgacctcagagacgga

SEQ ID NO: 26969 - DNA, 24 bp, Homo sapiens
acctgctgtgctggctcctggaac

SEQ ID NO: 26970 - DNA, 24 bp, Homo sapiens
agcacagaggcaccagggcagcag

SEQ ID NO: 26971 - DNA, 24 bp, Homo sapiens
atgtggagcggatggtggctgtgg

SEQ ID NO: 26972 - DNA, 24 bp, Homo sapiens
gctgctggatatgttcaacaaccg

SEQ ID NO: 26973 - DNA, 24 bp, Homo sapiens
cctgaagctcatccttctgcacgg

SEQ ID NO: 26974 - DNA, 24 bp, Homo sapiens
agcacagaggcaccagggcagcag

SEQ ID NO: 26975 - DNA, 24 bp, Homo sapiens
atgtggagcggatggtggctgtgg

SEQ ID NO: 26976 - DNA, 24 bp, Homo sapiens
cgcgggggaaggtgcaggaggggt

SEQ ID NO: 26977 - DNA, 24 bp, Homo sapiens
gcgcgggggaaggtgcaggagggg

SEQ ID NO: 26978 - DNA, 24 bp, Homo sapiens
cgcgcgggggaaggtgcaggaggg

SEQ ID NO: 26979 - DNA, 23 bp, Homo sapiens
cgcctgtggtgctgctgagtgag

SEQ ID NO: 26980 - DNA, 23 bp, Homo sapiens
ccgttgccttcgtgcttcgtcaa

SEQ ID NO: 26981 - DNA, 23 bp, Homo sapiens
gcgtggatgtgctgggtgctgag

SEQ ID NO: 26982 - DNA, 24 bp, Homo sapiens
acagtacatttgatgagtttggac

SEQ ID NO: 26983 - DNA, 24 bp, Homo sapiens
aacagtacatttgatgagtttgga

SEQ ID NO: 26984 - DNA, 24 bp, Homo sapiens
gaacagtacatttgatgagtttgg

SEQ ID NO: 26985 - DNA, 24 bp, Homo sapiens
gcaaaaaaattgaatcattaagag

SEQ ID NO: 26986 - DNA, 24 bp, Homo sapiens
ggcaaaaaaattgaatcattaaga

SEQ ID NO: 26987 - DNA, 24 bp, Homo sapiens
aggcaaaaaaattgaatcattaag

SEQ ID NO: 26988 - DNA, 25 bp, Homo sapiens
ggctccacagacagaatgaagaacc

SEQ ID NO: 26989 - DNA, 25 bp, Homo sapiens
caacagcagcaacgacaacatccag

SEQ ID NO: 26990 - DNA, 25 bp, Homo sapiens
agacgacaactctacagtgccaaca

SEQ ID NO: 26991 - DNA, 24 bp, Homo sapiens
tgccccgtgtcagaagagctgtcc

SEQ ID NO: 26992 - DNA, 24 bp, Homo sapiens
aatcttgatattaaatcattcatc

SEQ ID NO: 26993 - DNA, 24 bp, Homo sapiens
ttgctttacagcatagtggtaaaa

SEQ ID NO: 26994 - DNA, 24 bp, Homo sapiens
attgctttacagcatagtggtaaa

SEQ ID NO: 26995 - DNA, 24 bp, Homo sapiens
aattgctttacagcatagtggtaa

SEQ ID NO: 26996 - DNA, 24 bp, Homo sapiens
aggagcaaacccgcatgttggaaa

SEQ ID NO: 26997 - DNA, 24 bp, Homo sapiens
ctgacctcatctcacaagccagga

SEQ ID NO: 26998 - DNA, 24 bp, Homo sapiens
tgagcccatcactgccagcctcgg

SEQ ID NO: 26999 - DNA, 24 bp, Homo sapiens
gccgaacccacctgtgaggaatct

SEQ ID NO: 27000 - DNA, 24 bp, Homo sapiens
ttgacctgaccaccacccccaaag

SEQ ID NO: 27001 - DNA, 24 bp, Homo sapiens
gtcccaaggggcatgtacgatggg

SEQ ID NO: 27002 - DNA, 24 bp, Homo sapiens
ttatcgatgctgttggctttagtc

SEQ ID NO: 27003 - DNA, 24 bp, Homo sapiens
cttatcgatgctgttggctttagt

SEQ ID NO: 27004 - DNA, 24 bp, Homo sapiens
acttatcgatgctgttggctttag

SEQ ID NO: 27005 - DNA, 24 bp, Homo sapiens
tggaactgatggaaaaagatggaa

SEQ ID NO: 27006 - DNA, 24 bp, Homo sapiens
ttggaactgatggaaaaagatgga

SEQ ID NO: 27007 - DNA, 24 bp, Homo sapiens
gttggaactgatggaaaaagatgg

SEQ ID NO: 27008 - DNA, 24 bp, Homo sapiens
ggcaacaagagcgaaactccgtct

SEQ ID NO: 27009 - DNA, 24 bp, Homo sapiens
acaaaaagaaaaacaaatcagccg

SEQ ID NO: 27010 - DNA, 24 bp, Homo sapiens
tggtggcgcgcggctgtaatccca

SEQ ID NO: 27011 - DNA, 24 bp, Homo sapiens
gggtcattgaatacaaaggtgcca

SEQ ID NO: 27012 - DNA, 24 bp, Homo sapiens
ggggtcattgaatacaaaggtgcc

SEQ ID NO: 27013 - DNA, 24 bp, Homo sapiens
tggggtcattgaatacaaaggtgc

SEQ ID NO: 27014 - DNA, 24 bp, Homo sapiens
agcaattaatggtatatatttttg

SEQ ID NO: 27015 - DNA, 24 bp, Homo sapiens
aagcaattaatggtatatattttt

SEQ ID NO: 27016 - DNA, 24 bp, Homo sapiens
aaagcaattaatggtatatatttt

SEQ ID NO: 27017 - DNA, 24 bp, Homo sapiens
aacaatgaaaggtaaatcaaagca

SEQ ID NO: 27018 - DNA, 24 bp, Homo sapiens
aaacaatgaaaggtaaatcaaagc

SEQ ID NO: 27019 - DNA, 24 bp, Homo sapiens
taaacaatgaaaggtaaatcaaag

SEQ ID NO: 27020 - DNA, 24 bp, Homo sapiens
tattatttcagtgctctgccaatg

SEQ ID NO: 27021 - DNA, 24 bp, Homo sapiens
ttattatttcagtgctctgccaat

SEQ ID NO: 27022 - DNA, 24 bp, Homo sapiens
tttattatttcagtgctctgccaa

SEQ ID NO: 27023 - DNA, 24 bp, Homo sapiens
gtaacgattgatgggcggaggagc

SEQ ID NO: 27024 - DNA, 24 bp, Homo sapiens
caagttccaccagatcagcctcgg

SEQ ID NO: 27025 - DNA, 24 bp, Homo sapiens
catcaccctttcttggctccctgg

SEQ ID NO: 27026 - DNA, 24 bp, Homo sapiens
cgttattacagataatcttcaaag

SEQ ID NO: 27027 - DNA, 24 bp, Homo sapiens
acgttattacagataatcttcaaa

SEQ ID NO: 27028 - DNA, 24 bp, Homo sapiens
aacgttattacagataatcttcaa

SEQ ID NO: 27029 - DNA, 24 bp, Homo sapiens
tcttgtttcagtataccatagaaa

SEQ ID NO: 27030 - DNA, 24 bp, Homo sapiens
ttcttgtttcagtataccatagaa

SEQ ID NO: 27031 - DNA, 24 bp, Homo sapiens
cttcttgtttcagtataccataga

SEQ ID NO: 27032 - DNA, 24 bp, Homo sapiens
acgactgttaggtaagaatgagat

SEQ ID NO: 27033 - DNA, 24 bp, Homo sapiens
aacgactgttaggtaagaatgaga

SEQ ID NO: 27034 - DNA, 24 bp, Homo sapiens
caacgactgttaggtaagaatgag

SEQ ID NO: 27035 - DNA, 24 bp, Homo sapiens
tcatttttctggtaagagattata

SEQ ID NO: 27036 - DNA, 24 bp, Homo sapiens
ttcatttttctggtaagagattat

SEQ ID NO: 27037 - DNA, 24 bp, Homo sapiens
gttcatttttctggtaagagatta

SEQ ID NO: 27038 - DNA, 24 bp, Homo sapiens
tagtgcctcaagtaagtcttttac

SEQ ID NO: 27039 - DNA, 24 bp, Homo sapiens
atagtgcctcaagtaagtctttta

SEQ ID NO: 27040 - DNA, 24 bp, Homo sapiens
aatagtgcctcaagtaagtctttt

SEQ ID NO: 27041 - DNA, 25 bp, Homo sapiens
aaggaggaagaggaggaagtgagcc

SEQ ID NO: 27042 - DNA, 25 bp, Homo sapiens
tcacacttgggaaacttgggactgc

SEQ ID NO: 27043 - DNA, 23 bp, Homo sapiens
ccgaaggtggctggctttaggcg

SEQ ID NO: 27044 - DNA, 24 bp, Homo sapiens
atccagagacttcggctagagcat

SEQ ID NO: 27045 - DNA, 24 bp, Homo sapiens
agtcctcttcgtctcagccacctc

SEQ ID NO: 27046 - DNA, 25 bp, Homo sapiens
cggcttgatgaagaacacaggctaa

SEQ ID NO: 27047 - DNA, 24 bp, Homo sapiens
tctaagagtttggcgagtcagtga

SEQ ID NO: 27048 - DNA, 25 bp, Homo sapiens
aaataataagaaagcggctcctact

SEQ ID NO: 27049 - DNA, 24 bp, Homo sapiens
tcaaacctccctgcagaccaatgg

SEQ ID NO: 27050 - DNA, 25 bp, Homo sapiens
cggcttgatgaagaacacaggctaa

SEQ ID NO: 27051 - DNA, 24 bp, Homo sapiens
agtcctcttcgtctcagccacctc

SEQ ID NO: 27052 - DNA, 25 bp, Homo sapiens
agatccagagacttcggctagagca

SEQ ID NO: 27053 - DNA, 23 bp, Homo sapiens
ctgtgcttccagccgtgaacctt

SEQ ID NO: 27054 - DNA, 24 bp, Homo sapiens
ccagatcagcctgagaagccactc

SEQ ID NO: 27055 - DNA, 23 bp, Homo sapiens
ctgactaatgcattaagcaagtc

SEQ ID NO: 27056 - DNA, 24 bp, Homo sapiens
accctgttctcccactctgttccc

SEQ ID NO: 27057 - DNA, 25 bp, Homo sapiens
cggcttgatgaagaacacaggctaa

SEQ ID NO: 27058 - DNA, 24 bp, Homo sapiens
agtcctcttcgtctcagccacctc

SEQ ID NO: 27059 - DNA, 24 bp, Homo sapiens
agtcctcttcgtctcagccacctc

SEQ ID NO: 27060 - DNA, 25 bp, Homo sapiens
cggcttgatgaagaacacaggctaa

SEQ ID NO: 27061 - DNA, 25 bp, Homo sapiens
ttggctcacatcgttgatacttggc

SEQ ID NO: 27062 - DNA, 24 bp, Homo sapiens
ttccacagcagagaaagataatgc

SEQ ID NO: 27063 - DNA, 24 bp, Homo sapiens
tttccacagcagagaaagataatg

SEQ ID NO: 27064 - DNA, 24 bp, Homo sapiens
ttttccacagcagagaaagataat

SEQ ID NO: 27065 - DNA, 24 bp, Homo sapiens
aagtttatcaggaattatacctag

SEQ ID NO: 27066 - DNA, 24 bp, Homo sapiens
aaagtttatcaggaattataccta

SEQ ID NO: 27067 - DNA, 24 bp, Homo sapiens
gaaagtttatcaggaattatacct

SEQ ID NO: 27068 - DNA, 24 bp, Homo sapiens
tgccgtcatcggggcggacgtggt

SEQ ID NO: 27069 - DNA, 24 bp, Homo sapiens
atgccgtcatcggggcggacgtgg

SEQ ID NO: 27070 - DNA, 24 bp, Homo sapiens
aatgccgtcatcggggcggacgtg

SEQ ID NO: 27071 - DNA, 24 bp, Homo sapiens
catacggacatggcatcggtgacc

SEQ ID NO: 27072 - DNA, 24 bp, Homo sapiens
gctcggatgtggttgactggctct

SEQ ID NO: 27073 - DNA, 24 bp, Homo sapiens
caatgacaacgatggctccagtgg

SEQ ID NO: 27074 - DNA, 24 bp, Homo sapiens
tgtgtccagcagccatgagaatct

SEQ ID NO: 27075 - DNA, 24 bp, Homo sapiens
cccacctttacctcctttgccacc

SEQ ID NO: 27076 - DNA, 24 bp, Homo sapiens
gtggtatcctggctggtgtcctca

SEQ ID NO: 27077 - DNA, 24 bp, Homo sapiens
tggtgtcctggctggtgtcagctg

SEQ ID NO: 27078 - DNA, 24 bp, Homo sapiens
gtggtgtcctggctggtgtcagct

SEQ ID NO: 27079 - DNA, 24 bp, Homo sapiens
ggtggtgtcctggctggtgtcagc

SEQ ID NO: 27080 - DNA, 24 bp, Homo sapiens
tgggattacagtgttatagttttg

SEQ ID NO: 27081 - DNA, 24 bp, Homo sapiens
ctgggattacagtgttatagtttt

SEQ ID NO: 27082 - DNA, 24 bp, Homo sapiens
gctgggattacagtgttatagttt

SEQ ID NO: 27083 - DNA, 23 bp, Homo sapiens
ttcacggctacaggacagaggca

SEQ ID NO: 27084 - DNA, 23 bp, Homo sapiens
gctgttgcttctgctgcctctga

SEQ ID NO: 27085 - DNA, 23 bp, Homo sapiens
ggaccacagccagagcagccttg

SEQ ID NO: 27086 - DNA, 24 bp, Homo sapiens
agagacagaagattgccataatgc

SEQ ID NO: 27087 - DNA, 24 bp, Homo sapiens
gagagacagaagattgccataatg

SEQ ID NO: 27088 - DNA, 24 bp, Homo sapiens
agagagacagaagattgccataat

SEQ ID NO: 27089 - DNA, 24 bp, Homo sapiens
aacaaaaataggtgagaaaagaag

SEQ ID NO: 27090 - DNA, 24 bp, Homo sapiens
taacaaaaataggtgagaaaagaa

SEQ ID NO: 27091 - DNA, 24 bp, Homo sapiens
ttaacaaaaataggtgagaaaaga

SEQ ID NO: 27092 - DNA, 24 bp, Homo sapiens
tgtcaaaggaggttgaagtcaagg

SEQ ID NO: 27093 - DNA, 24 bp, Homo sapiens
gtgtcaaaggaggttgaagtcaag

SEQ ID NO: 27094 - DNA, 24 bp, Homo sapiens
tgtgtcaaaggaggttgaagtcaa

SEQ ID NO: 27095 - DNA, 24 bp, Homo sapiens
tgggtgctgaggtgcagtggtcca

SEQ ID NO: 27096 - DNA, 24 bp, Homo sapiens
ctgggtgctgaggtgcagtggtcc

SEQ ID NO: 27097 - DNA, 24 bp, Homo sapiens
cctgggtgctgaggtgcagtggtc

SEQ ID NO: 27098 - DNA, 25 bp, Homo sapiens
aagcagcatgtaacagactggcaca

SEQ ID NO: 27099 - DNA, 25 bp, Homo sapiens
gagggagtaacagaaagagcaaggc

SEQ ID NO: 27100 - DNA, 25 bp, Homo sapiens
tcactagaagcccaaacctcagcat

SEQ ID NO: 27101 - DNA, 24 bp, Homo sapiens
gaaatattgaagggtttcacagac

SEQ ID NO: 27102 - DNA, 24 bp, Homo sapiens
agaaatattgaagggtttcacaga

SEQ ID NO: 27103 - DNA, 24 bp, Homo sapiens
aagaaatattgaagggtttcacag

SEQ ID NO: 27104 - DNA, 24 bp, Homo sapiens
cctcatcaaagaccttctgtgttc

SEQ ID NO: 27105 - DNA, 24 bp, Homo sapiens
acctcatcaaagaccttctgtgtt

SEQ ID NO: 27106 - DNA, 24 bp, Homo sapiens
tacctcatcaaagaccttctgtgt

SEQ ID NO: 27107 - DNA, 23 bp, Homo sapiens
tccgttctccctcgaagcactcc

SEQ ID NO: 27108 - DNA, 23 bp, Homo sapiens
cagaagacctggctatggcacca

SEQ ID NO: 27109 - DNA, 25 bp, Homo sapiens
aggtggttgactcaatggttcagca

SEQ ID NO: 27110 - DNA, 24 bp, Homo sapiens
tggggcgtctgcggctggattgct

SEQ ID NO: 27111 - DNA, 24 bp, Homo sapiens
ctggggcgtctgcggctggattgc

SEQ ID NO: 27112 - DNA, 24 bp, Homo sapiens
gctggggcgtctgcggctggattg

SEQ ID NO: 27113 - DNA, 23 bp, Homo sapiens
gctcgggtgcagcgcagctcagc

SEQ ID NO: 27114 - DNA, 23 bp, Homo sapiens
gctccccgcccccagccccggag

SEQ ID NO: 27115 - DNA, 23 bp, Homo sapiens
gcgtgtggctggacaagtcactt

SEQ ID NO: 27116 - DNA, 23 bp, Homo sapiens
ggttcgggaggtgtggctggaga

SEQ ID NO: 27117 - DNA, 25 bp, Homo sapiens
atctgggtcaacaagtcctccttcg

SEQ ID NO: 27118 - DNA, 25 bp, Homo sapiens
aagtgttgggattacaggtgtgagc

SEQ ID NO: 27119 - DNA, 23 bp, Homo sapiens
gcctggccgaggctccttctttt

SEQ ID NO: 27120 - DNA, 24 bp, Homo sapiens
agccaggatggtctcagtctccag

SEQ ID NO: 27121 - DNA, 25 bp, Homo sapiens
aagacaagcacaagtatgaggaggc

SEQ ID NO: 27122 - DNA, 23 bp, Homo sapiens
cgcttctacgaacacgaggccac

SEQ ID NO: 27123 - DNA, 24 bp, Homo sapiens
agccaggatggtctcagtctccag

SEQ ID NO: 27124 - DNA, 24 bp, Homo sapiens
ttcttttatgaggagcgggaaggc

SEQ ID NO: 27125 - DNA, 25 bp, Homo sapiens
aagacaagcacaagtatgaggaggc

SEQ ID NO: 27126 - DNA, 24 bp, Homo sapiens
ctaataaaaaggtgaccgtggtcc

SEQ ID NO: 27127 - DNA, 24 bp, Homo sapiens
tctaataaaaaggtgaccgtggtc

SEQ ID NO: 27128 - DNA, 24 bp, Homo sapiens
gtctaataaaaaggtgaccgtggt

SEQ ID NO: 27129 - DNA, 24 bp, Homo sapiens
aacgcttcaaggtataactctagg

SEQ ID NO: 27130 - DNA, 24 bp, Homo sapiens
aaacgcttcaaggtataactctag

SEQ ID NO: 27131 - DNA, 24 bp, Homo sapiens
aaaacgcttcaaggtataactcta

SEQ ID NO: 27132 - DNA, 25 bp, Homo sapiens
gcctccttcctccatctctatgctg

SEQ ID NO: 27133 - DNA, 24 bp, Homo sapiens
gcagcccagcccactcatacttac

SEQ ID NO: 27134 - DNA, 25 bp, Homo sapiens
tgcctctttgatacagtacctgatc

SEQ ID NO: 27135 - DNA, 25 bp, Homo sapiens
gccagtccagagtagagtccgtagg

SEQ ID NO: 27136 - DNA, 25 bp, Homo sapiens
cacacacgcacaccctatcataccc

SEQ ID NO: 27137 - DNA, 23 bp, Homo sapiens
cctcattctgacctgccagctcc

SEQ ID NO: 27138 - DNA, 24 bp, Homo sapiens
cggtgctcagaaggctaccaagga

SEQ ID NO: 27139 - DNA, 24 bp, Homo sapiens
aagtgcatcaacaccgaaggtggt

SEQ ID NO: 27140 - DNA, 24 bp, Homo sapiens
ggtgtcccagtgtgcccccctgcc

SEQ ID NO: 27141 - DNA, 24 bp, Homo sapiens
accacccccagggacctggggcct

SEQ ID NO: 27142 - DNA, 24 bp, Homo sapiens
taccacccccagggacctggggcc

SEQ ID NO: 27143 - DNA, 24 bp, Homo sapiens
ctaccacccccagggacctggggc

SEQ ID NO: 27144 - DNA, 24 bp, Homo sapiens
gcaaggagttccactaccgaccgc

SEQ ID NO: 27145 - DNA, 24 bp, Homo sapiens
gtgacagtcccttcgcagaggtga

SEQ ID NO: 27146 - DNA, 24 bp, Homo sapiens
ctgctgtgcggctgtgtgatgagg

SEQ ID NO: 27147 - DNA, 24 bp, Homo sapiens
atgtggtgcttagcaaggaggtcc

SEQ ID NO: 27148 - DNA, 24 bp, Homo sapiens
cagccctgaccctgctctgaccac

SEQ ID NO: 27149 - DNA, 24 bp, Homo sapiens
agcactcaagcttgcctgcagccg

SEQ ID NO: 27150 - DNA, 24 bp, Homo sapiens
ctgccacctcacctgcccgccgtg

SEQ ID NO: 27151 - DNA, 24 bp, Homo sapiens
tctgccacctcacctgcccgccgt

SEQ ID NO: 27152 - DNA, 24 bp, Homo sapiens
ttctgccacctcacctgcccgccg

SEQ ID NO: 27153 - DNA, 24 bp, Homo sapiens
tctccacccagcctgcccacccgg

SEQ ID NO: 27154 - DNA, 24 bp, Homo sapiens
gtctccacccagcctgcccacccg

SEQ ID NO: 27155 - DNA, 24 bp, Homo sapiens
tgtctccacccagcctgcccaccc

SEQ ID NO: 27156 - DNA, 24 bp, Homo sapiens
ccgcaactcttccaggatgacgac

SEQ ID NO: 27157 - DNA, 24 bp, Homo sapiens
cgaacacacgctcacagagaagtt

SEQ ID NO: 27158 - DNA, 24 bp, Homo sapiens
cgagggctggactgggctcatctg

SEQ ID NO: 27159 - DNA, 24 bp, Homo sapiens
ttggtggcagcgtcctgttggtgg

SEQ ID NO: 27160 - DNA, 24 bp, Homo sapiens
ggacttgatggcgtacaaggtgcc

SEQ ID NO: 27161 - DNA, 24 bp, Homo sapiens
gtggtcggtactcacatgtagctg

SEQ ID NO: 27162 - DNA, 24 bp, Homo sapiens
cttggtggcagcgtcctgttggtg

SEQ ID NO: 27163 - DNA, 24 bp, Homo sapiens
cctcccagtggtcggtactcacat

SEQ ID NO: 27164 - DNA, 24 bp, Homo sapiens
ggcatcttcttctaccaccttggc

SEQ ID NO: 27165 - DNA, 24 bp, Homo sapiens
ctcagctacgagtgtcactgccag

SEQ ID NO: 27166 - DNA, 24 bp, Homo sapiens
gagtgtggctggtgtggcaatgag

SEQ ID NO: 27167 - DNA, 24 bp, Homo sapiens
gcttcctgacctgccatgagtgtc

SEQ ID NO: 27168 - DNA, 24 bp, Homo sapiens
atagaaatgggctgcaaagctgtc

SEQ ID NO: 27169 - DNA, 24 bp, Homo sapiens
gatagaaatgggctgcaaagctgt

SEQ ID NO: 27170 - DNA, 24 bp, Homo sapiens
tgatagaaatgggctgcaaagctg

SEQ ID NO: 27171 - DNA, 23 bp, Homo sapiens
gcacctccatcagtggcgatctc

SEQ ID NO: 27172 - DNA, 25 bp, Homo sapiens
tccttcacacatactcctcctctgg

SEQ ID NO: 27173 - DNA, 23 bp, Homo sapiens
aacaggacggacctccatgcctt

SEQ ID NO: 27174 - DNA, 25 bp, Homo sapiens
ctgctgggtgcggaagagaaagaat

SEQ ID NO: 27175 - DNA, 25 bp, Homo sapiens
gaactacttggaggaccgtcgcttg

SEQ ID NO: 27176 - DNA, 23 bp, Homo sapiens
ccttcggctgcctcctggactat

SEQ ID NO: 27177 - DNA, 24 bp, Homo sapiens
taaatagacggcccaggctcctcc

SEQ ID NO: 27178 - DNA, 24 bp, Homo sapiens
gtgtagccgaacggaagctgggag

SEQ ID NO: 27179 - DNA, 24 bp, Homo sapiens
gcggcggcacctccctcacccaag

SEQ ID NO: 27180 - DNA, 24 bp, Homo sapiens
gatcaatactgaggccgcgtccga

SEQ ID NO: 27181 - DNA, 24 bp, Homo sapiens
cccccagcccagcccccaccccac

SEQ ID NO: 27182 - DNA, 23 bp, Homo sapiens
ggtggttgctctgctgctggtga

SEQ ID NO: 27183 - DNA, 23 bp, Homo sapiens
ggaaggctgctgggctgaagaag

SEQ ID NO: 27184 - DNA, 25 bp, Homo sapiens
tctttccatccttgtctttgtgccc

SEQ ID NO: 27185 - DNA, 24 bp, Homo sapiens
gagatgaactggtgtatgtttcat

SEQ ID NO: 27186 - DNA, 24 bp, Homo sapiens
agagatgaactggtgtatgtttca

SEQ ID NO: 27187 - DNA, 24 bp, Homo sapiens
aagagatgaactggtgtatgtttc

SEQ ID NO: 27188 - DNA, 24 bp, Homo sapiens
tccttttatagatgatgaaatagc

SEQ ID NO: 27189 - DNA, 24 bp, Homo sapiens
ttccttttatagatgatgaaatag

SEQ ID NO: 27190 - DNA, 24 bp, Homo sapiens
tttccttttatagatgatgaaata

SEQ ID NO: 27191 - DNA, 24 bp, Homo sapiens
ctatttcagagagttaaaacaact

SEQ ID NO: 27192 - DNA, 24 bp, Homo sapiens
actatttcagagagttaaaacaac

SEQ ID NO: 27193 - DNA, 24 bp, Homo sapiens
aactatttcagagagttaaaacaa

SEQ ID NO: 27194 - DNA, 23 bp, Homo sapiens
tgctgagtccctgggtcacagtt

SEQ ID NO: 27195 - DNA, 25 bp, Homo sapiens
aagtgggctggctgagatttcatcc

SEQ ID NO: 27196 - DNA, 25 bp, Homo sapiens
cctcgaatcaagtgctacatccaat

SEQ ID NO: 27197 - DNA, 24 bp, Homo sapiens
aacttcagaaggtatgtttattaa

SEQ ID NO: 27198 - DNA, 24 bp, Homo sapiens
taacttcagaaggtatgtttatta

SEQ ID NO: 27199 - DNA, 24 bp, Homo sapiens
gtaacttcagaaggtatgtttatt

SEQ ID NO: 27200 - DNA, 24 bp, Homo sapiens
atataagtgaggaataaaagctgt

SEQ ID NO: 27201 - DNA, 24 bp, Homo sapiens
aatataagtgaggaataaaagctg

SEQ ID NO: 27202 - DNA, 24 bp, Homo sapiens
aaatataagtgaggaataaaagct

SEQ ID NO: 27203 - DNA, 24 bp, Homo sapiens
agcacaatcaggtttatttttcag

SEQ ID NO: 27204 - DNA, 24 bp, Homo sapiens
aagcacaatcaggtttatttttca

SEQ ID NO: 27205 - DNA, 24 bp, Homo sapiens
caagcacaatcaggtttatttttc

SEQ ID NO: 27206 - DNA, 23 bp, Homo sapiens
atggtggtggtggctgacaagac

SEQ ID NO: 27207 - DNA, 24 bp, Homo sapiens
atcgtggactacaaggcgttcatc

SEQ ID NO: 27208 - DNA, 23 bp, Homo sapiens
tcaagaggttcaacagcggcacg

SEQ ID NO: 27209 - DNA, 24 bp, Homo sapiens
ttcagaaaaagaatatgatagtga

SEQ ID NO: 27210 - DNA, 24 bp, Homo sapiens
attcagaaaaagaatatgatagtg

SEQ ID NO: 27211 - DNA, 24 bp, Homo sapiens
cattcagaaaaagaatatgatagt

SEQ ID NO: 27212 - DNA, 24 bp, Homo sapiens
ataagaacaagatcaatgatgaga

SEQ ID NO: 27213 - DNA, 24 bp, Homo sapiens
aataagaacaagatcaatgatgag

SEQ ID NO: 27214 - DNA, 24 bp, Homo sapiens
caataagaacaagatcaatgatga

SEQ ID NO: 27215 - DNA, 24 bp, Homo sapiens
aaagagcatagacatgttagtgtg

SEQ ID NO: 27216 - DNA, 24 bp, Homo sapiens
aaaagagcatagacatgttagtgt

SEQ ID NO: 27217 - DNA, 24 bp, Homo sapiens
gaaaagagcatagacatgttagtg

SEQ ID NO: 27218 - DNA, 24 bp, Homo sapiens
ataagtttaagtataaggcagaca

SEQ ID NO: 27219 - DNA, 24 bp, Homo sapiens
gataagtttaagtataaggcagac

SEQ ID NO: 27220 - DNA, 24 bp, Homo sapiens
agataagtttaagtataaggcaga

SEQ ID NO: 27221 - DNA, 23 bp, Homo sapiens
aatcagcaggcacaggaacaagt

SEQ ID NO: 27222 - DNA, 24 bp, Homo sapiens
cgctctacaggctctccgtcttga

SEQ ID NO: 27223 - DNA, 23 bp, Homo sapiens
actatgggaatttcagccgcagc

SEQ ID NO: 27224 - DNA, 24 bp, Homo sapiens
ggtctctgcctctcatcagtgtcc

SEQ ID NO: 27225 - DNA, 23 bp, Homo sapiens
ctgctgctgctcctgctgtggct

SEQ ID NO: 27226 - DNA, 24 bp, Homo sapiens
tgcctcatcgtccgcctctatctg

SEQ ID NO: 27227 - DNA, 23 bp, Homo sapiens
tacccgctgctgctgctgctgct

SEQ ID NO: 27228 - DNA, 25 bp, Homo sapiens
ctacgagacctactacagcctgagc

SEQ ID NO: 27229 - DNA, 23 bp, Homo sapiens
cgctcgcggcgctgctcgcagtg

SEQ ID NO: 27230 - DNA, 24 bp, Homo sapiens
tagcaacaaaggtttggagtataa

SEQ ID NO: 27231 - DNA, 24 bp, Homo sapiens
ctagcaacaaaggtttggagtata

SEQ ID NO: 27232 - DNA, 24 bp, Homo sapiens
actagcaacaaaggtttggagtat

SEQ ID NO: 27233 - DNA, 24 bp, Homo sapiens
aaaagataatggtatggtatctat

SEQ ID NO: 27234 - DNA, 24 bp, Homo sapiens
aaaaagataatggtatggtatcta

SEQ ID NO: 27235 - DNA, 24 bp, Homo sapiens
aaaaaagataatggtatggtatct

SEQ ID NO: 27236 - DNA, 23 bp, Homo sapiens
ctctccccgccgcctcaaccttc

SEQ ID NO: 27237 - DNA, 23 bp, Homo sapiens
gctgtcatggctgcgaccacccg

SEQ ID NO: 27238 - DNA, 23 bp, Homo sapiens
agcttggccttaaccctgacagg

SEQ ID NO: 27239 - DNA, 23 bp, Homo sapiens
ctgagttcctgtgcccttgcctg

SEQ ID NO: 27240 - DNA, 25 bp, Homo sapiens
actctctacttgacctgtaacccac

SEQ ID NO: 27241 - DNA, 25 bp, Homo sapiens
caagagaaaattctgcagccacagc

SEQ ID NO: 27242 - DNA, 23 bp, Homo sapiens
tcctcatcctacctggcgttccg

SEQ ID NO: 27243 - DNA, 25 bp, Homo sapiens
tgctaagtctccaccaatgatccct

SEQ ID NO: 27244 - DNA, 23 bp, Homo sapiens
tgctgctgctgtgctaagactgc

SEQ ID NO: 27245 - DNA, 23 bp, Homo sapiens
tgaggtggctggctgcattatgg

SEQ ID NO: 27246 - DNA, 24 bp, Homo sapiens
atggtggcagtggctgtgaagaac

SEQ ID NO: 27247 - DNA, 23 bp, Homo sapiens
acctgaattctgtgtcctcagct

SEQ ID NO: 27248 - DNA, 23 bp, Homo sapiens
ggcggagatggtggcagtggctg

SEQ ID NO: 27249 - DNA, 23 bp, Homo sapiens
tgaggtggctggctgcattatgg

SEQ ID NO: 27250 - DNA, 23 bp, Homo sapiens
acagaggtacctgaattctgtgt

SEQ ID NO: 27251 - DNA, 23 bp, Homo sapiens
ggaggaggagcccaggagcactg

SEQ ID NO: 27252 - DNA, 25 bp, Homo sapiens
ggctcctcaaggtcttctttgtgct

SEQ ID NO: 27253 - DNA, 23 bp, Homo sapiens
tcctcatcctacctggcgttccg

SEQ ID NO: 27254 - DNA, 25 bp, Homo sapiens
ggtggtcattcctgtggtgtctgtg

SEQ ID NO: 27255 - DNA, 24 bp, Homo sapiens
aacacaagatggcacggctccttc

SEQ ID NO: 27256 - DNA, 23 bp, Homo sapiens
ccatcaccaccaacaccagccag

SEQ ID NO: 27257 - DNA, 25 bp, Homo sapiens
tgctaagtctccaccaatgatccct

SEQ ID NO: 27258 - DNA, 23 bp, Homo sapiens
tgctgctgctgtgctaagactgc

SEQ ID NO: 27259 - DNA, 25 bp, Homo sapiens
ggtccttggaaacagttctggcaca

SEQ ID NO: 27260 - DNA, 24 bp, Homo sapiens
tgtgacctaaagtatatcctgatc

SEQ ID NO: 27261 - DNA, 24 bp, Homo sapiens
atgtgacctaaagtatatcctgat

SEQ ID NO: 27262 - DNA, 24 bp, Homo sapiens
tatgtgacctaaagtatatcctga

SEQ ID NO: 27263 - DNA, 24 bp, Homo sapiens
tacctgagaatgtaagtctgattt

SEQ ID NO: 27264 - DNA, 24 bp, Homo sapiens
ttacctgagaatgtaagtctgatt

SEQ ID NO: 27265 - DNA, 24 bp, Homo sapiens
tttacctgagaatgtaagtctgat

SEQ ID NO: 27266 - DNA, 24 bp, Homo sapiens
tgctggcagaagtattttgaagct

SEQ ID NO: 27267 - DNA, 24 bp, Homo sapiens
gtgctggcagaagtattttgaagc

SEQ ID NO: 27268 - DNA, 24 bp, Homo sapiens
tgtgctggcagaagtattttgaag

SEQ ID NO: 27269 - DNA, 24 bp, Homo sapiens
ttgacaaagagagtcattcagaaa

SEQ ID NO: 27270 - DNA, 24 bp, Homo sapiens
attgacaaagagagtcattcagaa

SEQ ID NO: 27271 - DNA, 24 bp, Homo sapiens
cattgacaaagagagtcattcaga

SEQ ID NO: 27272 - DNA, 24 bp, Homo sapiens
aggaggacttctctgtggtggtgg

SEQ ID NO: 27273 - DNA, 23 bp, Homo sapiens
cttgagggtggcgtctgtgctgt

SEQ ID NO: 27274 - DNA, 23 bp, Homo sapiens
ctgtgctatcgccaaggtgtgcc

SEQ ID NO: 27275 - DNA, 25 bp, Homo sapiens
gtgttagccaggatggtctcgatct

SEQ ID NO: 27276 - DNA, 23 bp, Homo sapiens
ctcgtgatccgcccgcctcggcc

SEQ ID NO: 27277 - DNA, 23 bp, Homo sapiens
gagtcgtggtgctggatgctgtg

SEQ ID NO: 27278 - DNA, 23 bp, Homo sapiens
ccgcttcctgctgattgccgccg

SEQ ID NO: 27279 - DNA, 23 bp, Homo sapiens
ccatcaaggtgtgggactacgcc

SEQ ID NO: 27280 - DNA, 24 bp, Homo sapiens
cagctgcaaggacagtcgaaggat

SEQ ID NO: 27281 - DNA, 24 bp, Homo sapiens
ccacctcggttttctaagaaagga

SEQ ID NO: 27282 - DNA, 24 bp, Homo sapiens
cataaccagagtcagggactctta

SEQ ID NO: 27283 - DNA, 26 bp, Homo sapiens
caaggacagtcgaaggatatgccacc

SEQ ID NO: 27284 - DNA, 22 bp, Homo sapiens
gagtcagggactcttatcccag

SEQ ID NO: 27285 - DNA, 24 bp, Homo sapiens
gccattgctaagatcaagatgttg

SEQ ID NO: 27286 - DNA, 24 bp, Homo sapiens
tcaaattcattggagagcttggca

SEQ ID NO: 27287 - DNA, 24 bp, Homo sapiens
atcccctcctccccgaggaggagg

SEQ ID NO: 27288 - DNA, 24 bp, Homo sapiens
ttaaactaactgctttcctgaatg

SEQ ID NO: 27289 - DNA, 24 bp, Homo sapiens
cttaaactaactgctttcctgaat

SEQ ID NO: 27290 - DNA, 24 bp, Homo sapiens
ccttaaactaactgctttcctgaa

SEQ ID NO: 27291 - DNA, 26 bp, Homo sapiens
gctctctccccgacacatttgttaaa

SEQ ID NO: 27292 - DNA, 22 bp, Homo sapiens
aaacctgaataaaactacaagt

SEQ ID NO: 27293 - DNA, 24 bp, Homo sapiens
aaacaataaaagtatgtttaaagt

SEQ ID NO: 27294 - DNA, 24 bp, Homo sapiens
aaaacaataaaagtatgtttaaag

SEQ ID NO: 27295 - DNA, 24 bp, Homo sapiens
caaaacaataaaagtatgtttaaa

SEQ ID NO: 27296 - DNA, 24 bp, Homo sapiens
caaaataacaggtttcctatgctc

SEQ ID NO: 27297 - DNA, 24 bp, Homo sapiens
acaaaataacaggtttcctatgct

SEQ ID NO: 27298 - DNA, 24 bp, Homo sapiens
gacaaaataacaggtttcctatgc

SEQ ID NO: 27299 - DNA, 24 bp, Homo sapiens
ctagagagcgagagcggtgagact

SEQ ID NO: 27300 - DNA, 24 bp, Homo sapiens
cgctccgccccacccagcctccgc

SEQ ID NO: 27301 - DNA, 24 bp, Homo sapiens
gggccggatcgcccggcggggaag

SEQ ID NO: 27302 - DNA, 23 bp, Homo sapiens
acagacgcacggacaagcagatg

SEQ ID NO: 27303 - DNA, 23 bp, Homo sapiens
actcttctgtgcctgcttagcgg

SEQ ID NO: 27304 - DNA, 24 bp, Homo sapiens
ccagtctcctcgacctcagtcctg

SEQ ID NO: 27305 - DNA, 24 bp, Homo sapiens
atgaacgacagcttggtgatccag

SEQ ID NO: 27306 - DNA, 24 bp, Homo sapiens
gatgaacgacagcttggtgatcca

SEQ ID NO: 27307 - DNA, 24 bp, Homo sapiens
ggatgaacgacagcttggtgatcc

SEQ ID NO: 27308 - DNA, 24 bp, Homo sapiens
ggtctagcctgtgtggaagagccc

SEQ ID NO: 27309 - DNA, 24 bp, Homo sapiens
tggaggatgaacgacagcttggtg

SEQ ID NO: 27310 - DNA, 24 bp, Homo sapiens
gctttattatggctgctgttgtcc

SEQ ID NO: 27311 - DNA, 23 bp, Homo sapiens
gccgccaccaccattaccttctg

SEQ ID NO: 27312 - DNA, 25 bp, Homo sapiens
ggcaactatccgtgaaggacactgt

SEQ ID NO: 27313 - DNA, 24 bp, Homo sapiens
ctcaccttagaacggccctctcca

SEQ ID NO: 27314 - DNA, 24 bp, Homo sapiens
atcctcccacttcagcctccaaag

SEQ ID NO: 27315 - DNA, 23 bp, Homo sapiens
ggattacaggcatgagccaccgc

SEQ ID NO: 27316 - DNA, 25 bp, Homo sapiens
cccaaataaattaaccaaagctgaa

SEQ ID NO: 27317 - DNA, 24 bp, Homo sapiens
agccgatcttctgtgttctgcgtg

SEQ ID NO: 27318 - DNA, 23 bp, Homo sapiens
aacttcctgccttgctaccgtgg

SEQ ID NO: 27319 - DNA, 23 bp, Homo sapiens
aagcagcagcggcagcacctaag

SEQ ID NO: 27320 - DNA, 24 bp, Homo sapiens
ctgcaataagggtaagaattgttt

SEQ ID NO: 27321 - DNA, 24 bp, Homo sapiens
tctgcaataagggtaagaattgtt

SEQ ID NO: 27322 - DNA, 24 bp, Homo sapiens
atctgcaataagggtaagaattgt

SEQ ID NO: 27323 - DNA, 24 bp, Homo sapiens
cacacaactatcaaggagcagagc

SEQ ID NO: 27324 - DNA, 24 bp, Homo sapiens
gagccaccacgccctgccaataaa

SEQ ID NO: 27325 - DNA, 24 bp, Homo sapiens
gctggtctggaactcctgggatca

SEQ ID NO: 27326 - DNA, 24 bp, Homo sapiens
gaagggcgtgaaacaggaaaggct

SEQ ID NO: 27327 - DNA, 24 bp, Homo sapiens
tctccagatgctgactaaggtaca

SEQ ID NO: 27328 - DNA, 24 bp, Homo sapiens
gagccaccacgccctgccaataaa

SEQ ID NO: 27329 - DNA, 25 bp, Homo sapiens
cttcactgtcggacccaagaccttt

SEQ ID NO: 27330 - DNA, 23 bp, Homo sapiens
tggagcagcagccgtctgtggag

SEQ ID NO: 27331 - DNA, 23 bp, Homo sapiens
ccatgtgccagaaggagttcgcc

SEQ ID NO: 27332 - DNA, 25 bp, Homo sapiens
gcactacaagatccgccagaactcc

SEQ ID NO: 27333 - DNA, 25 bp, Homo sapiens
cgcttctacttcctctacggcttcg

SEQ ID NO: 27334 - DNA, 23 bp, Homo sapiens
gccatgaccatccagcacatcgt

SEQ ID NO: 27335 - DNA, 23 bp, Homo sapiens
tccatccaaggtcacacgggagg

SEQ ID NO: 27336 - DNA, 24 bp, Homo sapiens
ggtggcttcgagtggaacatgagg

SEQ ID NO: 27337 - DNA, 23 bp, Homo sapiens
tgtgggcagtggcttgttcatcg

SEQ ID NO: 27338 - DNA, 25 bp, Homo sapiens
aggaccaagaagaggaagaagacca

SEQ ID NO: 27339 - DNA, 25 bp, Homo sapiens
ggaacagtaccttggcttggctctt

SEQ ID NO: 27340 - DNA, 24 bp, Homo sapiens
gcgtattggcttggctgttgacat

SEQ ID NO: 27341 - DNA, 24 bp, Homo sapiens
gaagccggagggggctcaagccag

SEQ ID NO: 27342 - DNA, 24 bp, Homo sapiens
ggaagccggagggggctcaagcca

SEQ ID NO: 27343 - DNA, 24 bp, Homo sapiens
cggaagccggagggggctcaagcc

SEQ ID NO: 27344 - DNA, 24 bp, Homo sapiens
gggagaaaaagaatcttcatgaca

SEQ ID NO: 27345 - DNA, 24 bp, Homo sapiens
agggagaaaaagaatcttcatgac

SEQ ID NO: 27346 - DNA, 24 bp, Homo sapiens
gagggagaaaaagaatcttcatga

SEQ ID NO: 27347 - DNA, 24 bp, Homo sapiens
gcagaaagcagatattaaaatcaa

SEQ ID NO: 27348 - DNA, 24 bp, Homo sapiens
agcagaaagcagatattaaaatca

SEQ ID NO: 27349 - DNA, 24 bp, Homo sapiens
aagcagaaagcagatattaaaatc

SEQ ID NO: 27350 - DNA, 24 bp, Homo sapiens
tctgattataggtaacaaaggaat

SEQ ID NO: 27351 - DNA, 24 bp, Homo sapiens
atctgattataggtaacaaaggaa

SEQ ID NO: 27352 - DNA, 24 bp, Homo sapiens
tatctgattataggtaacaaagga

SEQ ID NO: 27353 - DNA, 24 bp, Homo sapiens
ggtgcaggcagaggtggctggtgg

SEQ ID NO: 27354 - DNA, 24 bp, Homo sapiens
tggtgcaggcagaggtggctggtg

SEQ ID NO: 27355 - DNA, 24 bp, Homo sapiens
gtggtgcaggcagaggtggctggt

SEQ ID NO: 27356 - DNA, 25 bp, Homo sapiens
gtgtcagagcccttcatggagtcct

SEQ ID NO: 27357 - DNA, 23 bp, Homo sapiens
ctacccgcagagcagtccctgac

SEQ ID NO: 27358 - DNA, 23 bp, Homo sapiens
cttgcctgcctgctgcgagacac

SEQ ID NO: 27359 - DNA, 24 bp, Homo sapiens
ctccaccgccgcctcggaacccag

SEQ ID NO: 27360 - DNA, 24 bp, Homo sapiens
ggggcggtggggccgcgtatggag

SEQ ID NO: 27361 - DNA, 24 bp, Homo sapiens
cctagcattcacttctggagcacc

SEQ ID NO: 27362 - DNA, 24 bp, Homo sapiens
gctctccttccagtttccatccag

SEQ ID NO: 27363 - DNA, 24 bp, Homo sapiens
ctctccagccagccatctcaagga

SEQ ID NO: 27364 - DNA, 23 bp, Homo sapiens
gactggcatccctcaagacacgg

SEQ ID NO: 27365 - DNA, 23 bp, Homo sapiens
gtgcggtgtgcctggactacttc

SEQ ID NO: 27366 - DNA, 25 bp, Homo sapiens
ccctgtaagcacgagtttcaccgag

SEQ ID NO: 27367 - DNA, 23 bp, Homo sapiens
ctggtccctggcttgtccctcac

SEQ ID NO: 27368 - DNA, 25 bp, Homo sapiens
tgagtggcgatactattatgactgc

SEQ ID NO: 27369 - DNA, 25 bp, Homo sapiens
tgcttgttcctattcatgcctatcc

SEQ ID NO: 27370 - DNA, 24 bp, Homo sapiens
gtctttttcagcaacagaaattgc

SEQ ID NO: 27371 - DNA, 24 bp, Homo sapiens
tgtctttttcagcaacagaaattg

SEQ ID NO: 27372 - DNA, 24 bp, Homo sapiens
ttgtctttttcagcaacagaaatt

SEQ ID NO: 27373 - DNA, 24 bp, Homo sapiens
tgaaaatacttgtggcatttctgg

SEQ ID NO: 27374 - DNA, 24 bp, Homo sapiens
atgaaaatacttgtggcatttctg

SEQ ID NO: 27375 - DNA, 24 bp, Homo sapiens
aatgaaaatacttgtggcatttct

SEQ ID NO: 27376 - DNA, 24 bp, Homo sapiens
agaagaagaaacttgaaagattta

SEQ ID NO: 27377 - DNA, 24 bp, Homo sapiens
aagaagaagaaacttgaaagattt

SEQ ID NO: 27378 - DNA, 24 bp, Homo sapiens
gaagaagaagaaacttgaaagatt

SEQ ID NO: 27379 - DNA, 24 bp, Homo sapiens
gaagcaaaaagcaaataatttccc

SEQ ID NO: 27380 - DNA, 24 bp, Homo sapiens
agaagcaaaaagcaaataatttcc

SEQ ID NO: 27381 - DNA, 24 bp, Homo sapiens
aagaagcaaaaagcaaataatttc

SEQ ID NO: 27382 - DNA, 25 bp, Homo sapiens
tgttggcatcattaggtcagcaggt

SEQ ID NO: 27383 - DNA, 23 bp, Homo sapiens
ctcaagcaatcctcccgcctcag

SEQ ID NO: 27384 - DNA, 25 bp, Homo sapiens
ctggacaactcctgacattctgtga

SEQ ID NO: 27385 - DNA, 24 bp, Homo sapiens
catcctttcagagtacagaatttt

SEQ ID NO: 27386 - DNA, 24 bp, Homo sapiens
tcatcctttcagagtacagaattt

SEQ ID NO: 27387 - DNA, 24 bp, Homo sapiens
ttcatcctttcagagtacagaatt

SEQ ID NO: 27388 - DNA, 24 bp, Homo sapiens
ctgccttttagatgatagatttat

SEQ ID NO: 27389 - DNA, 24 bp, Homo sapiens
tctgccttttagatgatagattta

SEQ ID NO: 27390 - DNA, 24 bp, Homo sapiens
ttctgccttttagatgatagattt

SEQ ID NO: 27391 - DNA, 24 bp, Homo sapiens
agcccagctccgagctgcagctgg

SEQ ID NO: 27392 - DNA, 24 bp, Homo sapiens
aagcccagctccgagctgcagctg

SEQ ID NO: 27393 - DNA, 24 bp, Homo sapiens
aaagcccagctccgagctgcagct

SEQ ID NO: 27394 - DNA, 24 bp, Homo sapiens
ttctgtgccaggtgcggtggttcc

SEQ ID NO: 27395 - DNA, 24 bp, Homo sapiens
cttctgtgccaggtgcggtggttc

SEQ ID NO: 27396 - DNA, 24 bp, Homo sapiens
ccttctgtgccaggtgcggtggtt

SEQ ID NO: 27397 - DNA, 24 bp, Homo sapiens
ccaggcagcagcagcagcggcagc

SEQ ID NO: 27398 - DNA, 24 bp, Homo sapiens
caaggctggttacccaacagggac

SEQ ID NO: 27399 - DNA, 24 bp, Homo sapiens
ctatgggcccggaggagtggctgg

SEQ ID NO: 27400 - DNA, 25 bp, Homo sapiens
aattgaagccatccggttgtatctg

SEQ ID NO: 27401 - DNA, 25 bp, Homo sapiens
attcaatcttgcctgactactacaa

SEQ ID NO: 27402 - DNA, 24 bp, Homo sapiens
tgtgatcactgttatcatcctaat

SEQ ID NO: 27403 - DNA, 24 bp, Homo sapiens
taagcaaagccaaaaagcattttc

SEQ ID NO: 27404 - DNA, 24 bp, Homo sapiens
ataagcaaagccaaaaagcatttt

SEQ ID NO: 27405 - DNA, 24 bp, Homo sapiens
aataagcaaagccaaaaagcattt

SEQ ID NO: 27406 - DNA, 24 bp, Homo sapiens
aatattgggaggatttcagtattt

SEQ ID NO: 27407 - DNA, 24 bp, Homo sapiens
caatattgggaggatttcagtatt

SEQ ID NO: 27408 - DNA, 24 bp, Homo sapiens
acaatattgggaggatttcagtat

SEQ ID NO: 27409 - DNA, 24 bp, Homo sapiens
aaaatcaatcagatctctaatagg

SEQ ID NO: 27410 - DNA, 24 bp, Homo sapiens
caaaatcaatcagatctctaatag

SEQ ID NO: 27411 - DNA, 24 bp, Homo sapiens
ccaaaatcaatcagatctctaata

SEQ ID NO: 27412 - DNA, 23 bp, Homo sapiens
cagttgctgcggctggttcaagc

SEQ ID NO: 27413 - DNA, 23 bp, Homo sapiens
cggatgggaagtggtgggaggag

SEQ ID NO: 27414 - DNA, 25 bp, Homo sapiens
ttcctcccgacttatccactttagg

SEQ ID NO: 27415 - DNA, 24 bp, Homo sapiens
actggagattcaagtggcaacatc

SEQ ID NO: 27416 - DNA, 23 bp, Homo sapiens
ctggtgtcgggaggtgggaaaga

SEQ ID NO: 27417 - DNA, 24 bp, Homo sapiens
aaggcgatgtgatcttgattggca

SEQ ID NO: 27418 - DNA, 23 bp, Homo sapiens
gtggtgtctgtgctgtgctgctt

SEQ ID NO: 27419 - DNA, 23 bp, Homo sapiens
gaggcggactctgctctggaaga

SEQ ID NO: 27420 - DNA, 23 bp, Homo sapiens
cctggaggatgccgtctacctgt

SEQ ID NO: 27421 - DNA, 25 bp, Homo sapiens
atcatagcagaacttcagacaacca

SEQ ID NO: 27422 - DNA, 24 bp, Homo sapiens
aagaagagaacagccagcagcagc

SEQ ID NO: 27423 - DNA, 23 bp, Homo sapiens
aaggcggctccaggatgttagac

SEQ ID NO: 27424 - DNA, 24 bp, Homo sapiens
cactggaaaaggttttacaagatg

SEQ ID NO: 27425 - DNA, 24 bp, Homo sapiens
acactggaaaaggttttacaagat

SEQ ID NO: 27426 - DNA, 24 bp, Homo sapiens
gacactggaaaaggttttacaaga

SEQ ID NO: 27427 - DNA, 25 bp, Homo sapiens
cgcacctattacagcagcataacgc

SEQ ID NO: 27428 - DNA, 25 bp, Homo sapiens
atagcctagtccgagaccatgaacg

SEQ ID NO: 27429 - DNA, 24 bp, Homo sapiens
cacaggttattgccgacatggagg

SEQ ID NO: 27430 - DNA, 23 bp, Homo sapiens
actgtcaagttatcagagagact

SEQ ID NO: 27431 - DNA, 23 bp, Homo sapiens
aacaaagtacggaatctctaaat

SEQ ID NO: 27432 - DNA, 25 bp, Homo sapiens
gaccagattgcagagctgaaaaaga

SEQ ID NO: 27433 - DNA, 24 bp, Homo sapiens
accccagcaagacattcaccccaa

SEQ ID NO: 27434 - DNA, 24 bp, Homo sapiens
gaccccagcaagacattcacccca

SEQ ID NO: 27435 - DNA, 24 bp, Homo sapiens
tgaccccagcaagacattcacccc

SEQ ID NO: 27436 - DNA, 23 bp, Homo sapiens
gctgccgagtccaggtgtcccgc

SEQ ID NO: 27437 - DNA, 23 bp, Homo sapiens
tcccgcagcgaccacctacccag

SEQ ID NO: 27438 - DNA, 23 bp, Homo sapiens
gtgacatccctgccgtgggcttg

SEQ ID NO: 27439 - DNA, 23 bp, Homo sapiens
gttcttacccctaccacacgctg

SEQ ID NO: 27440 - DNA, 23 bp, Homo sapiens
gactccacgccccccagcagcag

SEQ ID NO: 27441 - DNA, 23 bp, Homo sapiens
gatccccagtgggccctggcagg

SEQ ID NO: 27442 - DNA, 24 bp, Homo sapiens
gtgtcattgccctcctggtcttcg

SEQ ID NO: 27443 - DNA, 24 bp, Homo sapiens
tgccagtgaagatgccctcaagac

SEQ ID NO: 27444 - DNA, 24 bp, Homo sapiens
tgttggtattgctggctggtatct

SEQ ID NO: 27445 - DNA, 25 bp, Homo sapiens
tggacttctagggatctcagccgtg

SEQ ID NO: 27446 - DNA, 25 bp, Homo sapiens
gggaaggacctgaaggatttggagt

SEQ ID NO: 27447 - DNA, 23 bp, Homo sapiens
gagtccctgcctctcctccctgg

SEQ ID NO: 27448 - DNA, 25 bp, Homo sapiens
ggcactccatcatcaacgctctcaa

SEQ ID NO: 27449 - DNA, 25 bp, Homo sapiens
ttgataagcagcgagaagagatggc

SEQ ID NO: 27450 - DNA, 24 bp, Homo sapiens
caccaccttccaggagaaccaagc

SEQ ID NO: 27451 - DNA, 24 bp, Homo sapiens
tggtctacgtggtcatggacgaca

SEQ ID NO: 27452 - DNA, 23 bp, Homo sapiens
ccctacgctctggcctttgctgc

SEQ ID NO: 27453 - DNA, 23 bp, Homo sapiens
cctttgccgtggtgctggctgag

SEQ ID NO: 27454 - DNA, 24 bp, Homo sapiens
tttgataaaaggcactggtgaggt

SEQ ID NO: 27455 - DNA, 24 bp, Homo sapiens
ctttgataaaaggcactggtgagg

SEQ ID NO: 27456 - DNA, 24 bp, Homo sapiens
gctttgataaaaggcactggtgag

SEQ ID NO: 27457 - DNA, 24 bp, Homo sapiens
ctggtacaggatgtcattggcgac

SEQ ID NO: 27458 - DNA, 23 bp, Homo sapiens
cacctgaagcagcagcaccatca

SEQ ID NO: 27459 - DNA, 25 bp, Homo sapiens
tggtacagatgtgcaagatgaaggc

SEQ ID NO: 27460 - DNA, 23 bp, Homo sapiens
cctctacctggctctcgtcctgg

SEQ ID NO: 27461 - DNA, 23 bp, Homo sapiens
cgcctccagcctgcttgccacag

SEQ ID NO: 27462 - DNA, 24 bp, Homo sapiens
agaagctgcgaggaggtacaagaa

SEQ ID NO: 27463 - DNA, 24 bp, Homo sapiens
gtaagtctcacgagatctgatggt

SEQ ID NO: 27464 - DNA, 24 bp, Homo sapiens
taaatgggagatccccgcacaagc

SEQ ID NO: 27465 - DNA, 25 bp, Homo sapiens
cgggatgtgatgctggagaactttg

SEQ ID NO: 27466 - DNA, 23 bp, Homo sapiens
ggctccttaatgtgacccagaag

SEQ ID NO: 27467 - DNA, 23 bp, Homo sapiens
ttgcagggcttggtgatgtttga

SEQ ID NO: 27468 - DNA, 24 bp, Homo sapiens
gctaccgccagtcatccacatacc

SEQ ID NO: 27469 - DNA, 24 bp, Homo sapiens
acaattcttctgcctcagcctcct

SEQ ID NO: 27470 - DNA, 24 bp, Homo sapiens
agagaagacacaggaatgagaggc

SEQ ID NO: 27471 - DNA, 25 bp, Homo sapiens
aggaggcacatcagataaacccagt

SEQ ID NO: 27472 - DNA, 24 bp, Homo sapiens
aatcaatcactgacatggagctgg

SEQ ID NO: 27473 - DNA, 25 bp, Homo sapiens
acaattcttctgcctcagcctcctg

SEQ ID NO: 27474 - DNA, 24 bp, Homo sapiens
tttcattgcagtttaattataact

SEQ ID NO: 27475 - DNA, 24 bp, Homo sapiens
ctttcattgcagtttaattataac

SEQ ID NO: 27476 - DNA, 24 bp, Homo sapiens
tctttcattgcagtttaattataa

SEQ ID NO: 27477 - DNA, 23 bp, Homo sapiens
ggtgtggttgtgatggattctgc

SEQ ID NO: 27478 - DNA, 25 bp, Homo sapiens
gttacatcacagatttcctagcccg

SEQ ID NO: 27479 - DNA, 25 bp, Homo sapiens
tcccatctgatacatctgacacatc

SEQ ID NO: 27480 - DNA, 23 bp, Homo sapiens
tgggacagggacaaggaccgatt

SEQ ID NO: 27481 - DNA, 25 bp, Homo sapiens
tgtgcctacagaattgccatcttgc

SEQ ID NO: 27482 - DNA, 25 bp, Homo sapiens
ctcatcctttaggctttggctgaca

SEQ ID NO: 27483 - DNA, 24 bp, Homo sapiens
tcattccattagtaagttaataaa

SEQ ID NO: 27484 - DNA, 24 bp, Homo sapiens
atcattccattagtaagttaataa

SEQ ID NO: 27485 - DNA, 24 bp, Homo sapiens
catcattccattagtaagttaata

SEQ ID NO: 27486 - DNA, 24 bp, Homo sapiens
atttattctaggacttacttctct

SEQ ID NO: 27487 - DNA, 24 bp, Homo sapiens
tatttattctaggacttacttctc

SEQ ID NO: 27488 - DNA, 24 bp, Homo sapiens
ttatttattctaggacttacttct

SEQ ID NO: 27489 - DNA, 25 bp, Homo sapiens
aagcctgggacaactcaaatagtgc

SEQ ID NO: 27490 - DNA, 23 bp, Homo sapiens
tttcaggtgtttctgcccagttt

SEQ ID NO: 27491 - DNA, 25 bp, Homo sapiens
cgccatcaccatcggaatcatcaga

SEQ ID NO: 27492 - DNA, 24 bp, Homo sapiens
ctgcctaccagaagacagtacctg

SEQ ID NO: 27493 - DNA, 23 bp, Homo sapiens
aagagcaggaggacaggcggaag

SEQ ID NO: 27494 - DNA, 23 bp, Homo sapiens
caaggagcggcaggagcaggaag

SEQ ID NO: 27495 - DNA, 24 bp, Homo sapiens
catttacacagaactatttcaagc

SEQ ID NO: 27496 - DNA, 24 bp, Homo sapiens
tcatttacacagaactatttcaag

SEQ ID NO: 27497 - DNA, 24 bp, Homo sapiens
ctcatttacacagaactatttcaa

SEQ ID NO: 27498 - DNA, 24 bp, Homo sapiens
agcaatgtcagtagaaaccattga

SEQ ID NO: 27499 - DNA, 24 bp, Homo sapiens
cagcaatgtcagtagaaaccattg

SEQ ID NO: 27500 - DNA, 24 bp, Homo sapiens
tcagcaatgtcagtagaaaccatt

SEQ ID NO: 27501 - DNA, 24 bp, Homo sapiens
ggctgtagttgtagtgactcctcc

SEQ ID NO: 27502 - DNA, 24 bp, Homo sapiens
ctaatcggctgggtgtgatggtgg

SEQ ID NO: 27503 - DNA, 23 bp, Homo sapiens
ggcgtggtggcacatgactgtaa

SEQ ID NO: 27504 - DNA, 24 bp, Homo sapiens
aaacttttaagaatgtaatggttt

SEQ ID NO: 27505 - DNA, 24 bp, Homo sapiens
caaacttttaagaatgtaatggtt

SEQ ID NO: 27506 - DNA, 24 bp, Homo sapiens
acaaacttttaagaatgtaatggt

SEQ ID NO: 27507 - DNA, 24 bp, Homo sapiens
cccagcaccccctccccgcccatc

SEQ ID NO: 27508 - DNA, 24 bp, Homo sapiens
aggactgctgctgtcactgccatc

SEQ ID NO: 27509 - DNA, 24 bp, Homo sapiens
ataccacagccttcatctgcgccc

SEQ ID NO: 27510 - DNA, 24 bp, Homo sapiens
tttcatttcagatacacatttttc

SEQ ID NO: 27511 - DNA, 24 bp, Homo sapiens
ctttcatttcagatacacattttt

SEQ ID NO: 27512 - DNA, 24 bp, Homo sapiens
gctttcatttcagatacacatttt

SEQ ID NO: 27513 - DNA, 24 bp, Homo sapiens
gttttgggaaggtctgcattgtac

SEQ ID NO: 27514 - DNA, 24 bp, Homo sapiens
agttttgggaaggtctgcattgta

SEQ ID NO: 27515 - DNA, 24 bp, Homo sapiens
cagttttgggaaggtctgcattgt

SEQ ID NO: 27516 - DNA, 25 bp, Homo sapiens
atggttataggcggaagggatttgc

SEQ ID NO: 27517 - DNA, 25 bp, Homo sapiens
agatgagactttggactgtggactt

SEQ ID NO: 27518 - DNA, 24 bp, Homo sapiens
gtcgttctggaccttgttctggaa

SEQ ID NO: 27519 - DNA, 25 bp, Homo sapiens
agatgagactttggactgtggactt

SEQ ID NO: 27520 - DNA, 24 bp, Homo sapiens
gtcgttctggaccttgttctggaa

SEQ ID NO: 27521 - DNA, 23 bp, Homo sapiens
aatcagcaacagaatccttgagc

SEQ ID NO: 27522 - DNA, 24 bp, Homo sapiens
agggcaggaggaagggaagaaaga

SEQ ID NO: 27523 - DNA, 24 bp, Homo sapiens
gaacagcttccttaatgcaccctg

SEQ ID NO: 27524 - DNA, 24 bp, Homo sapiens
ggagttcaggtcccctaatccagg

SEQ ID NO: 27525 - DNA, 24 bp, Homo sapiens
accgccaccgccactaccaccgtc

SEQ ID NO: 27526 - DNA, 24 bp, Homo sapiens
agctcctgactcatcgggggctcc

SEQ ID NO: 27527 - DNA, 24 bp, Homo sapiens
acccgcgctcgtacgtgcgcctcc

SEQ ID NO: 27528 - DNA, 23 bp, Homo sapiens
gagaagaggaggatgcggctcgt

SEQ ID NO: 27529 - DNA, 23 bp, Homo sapiens
ttggcaggtctctgaaggtcggc

SEQ ID NO: 27530 - DNA, 24 bp, Homo sapiens
atctccctggactactggtggtgc

SEQ ID NO: 27531 - DNA, 23 bp, Homo sapiens
tgagcccctcggcgggtcctcgc

SEQ ID NO: 27532 - DNA, 23 bp, Homo sapiens
gaccctgagccgcagccccgcga

SEQ ID NO: 27533 - DNA, 23 bp, Homo sapiens
cgcatttcggggaccggcccgcg

SEQ ID NO: 27534 - DNA, 25 bp, Homo sapiens
acccaaacacaaagcagtagtaact

SEQ ID NO: 27535 - DNA, 24 bp, Homo sapiens
ttcagaaggcaacggataacatcg

SEQ ID NO: 27536 - DNA, 23 bp, Homo sapiens
gtctttccttccgtggtcacagc

SEQ ID NO: 27537 - DNA, 24 bp, Homo sapiens
tttcttctcaaatagtcagaacat

SEQ ID NO: 27538 - DNA, 24 bp, Homo sapiens
ctttcttctcaaatagtcagaaca

SEQ ID NO: 27539 - DNA, 24 bp, Homo sapiens
gctttcttctcaaatagtcagaac

SEQ ID NO: 27540 - DNA, 24 bp, Homo sapiens
tggacgtaggggccagctgctgcc

SEQ ID NO: 27541 - DNA, 24 bp, Homo sapiens
atggacgtaggggccagctgctgc

SEQ ID NO: 27542 - DNA, 24 bp, Homo sapiens
gatggacgtaggggccagctgctg

SEQ ID NO: 27543 - DNA, 24 bp, Homo sapiens
gctggatttagacctgagggagaa

SEQ ID NO: 27544 - DNA, 24 bp, Homo sapiens
ccttgaccacattcccttcctgcc

SEQ ID NO: 27545 - DNA, 24 bp, Homo sapiens
aggcaagcagagaccacactgatg

SEQ ID NO: 27546 - DNA, 24 bp, Homo sapiens
gcgttctcggaacctcaaatcatc

SEQ ID NO: 27547 - DNA, 24 bp, Homo sapiens
agcgttctcggaacctcaaatcat

SEQ ID NO: 27548 - DNA, 24 bp, Homo sapiens
cagcgttctcggaacctcaaatca

SEQ ID NO: 27549 - DNA, 23 bp, Homo sapiens
caatcttcctgcctcagcctgct

SEQ ID NO: 27550 - DNA, 24 bp, Homo sapiens
cgcaccaccatacccagctacttg

SEQ ID NO: 27551 - DNA, 25 bp, Homo sapiens
ctgaccccgatttgccctattctgc

SEQ ID NO: 27552 - DNA, 24 bp, Homo sapiens
ttatagtacaggcaactactctaa

SEQ ID NO: 27553 - DNA, 24 bp, Homo sapiens
tttatagtacaggcaactactcta

SEQ ID NO: 27554 - DNA, 24 bp, Homo sapiens
atttatagtacaggcaactactct

SEQ ID NO: 27555 - DNA, 24 bp, Homo sapiens
aagaggcaaaggcagaggagaaca

SEQ ID NO: 27556 - DNA, 24 bp, Homo sapiens
aggaggaagtaacttgtggaatgc

SEQ ID NO: 27557 - DNA, 24 bp, Homo sapiens
gaaagaatgaagctatgaatcctg

SEQ ID NO: 27558 - DNA, 24 bp, Homo sapiens
tcctcccagtcacctttctccacc

SEQ ID NO: 27559 - DNA, 24 bp, Homo sapiens
ggttcccttctctccgtcctcttt

SEQ ID NO: 27560 - DNA, 24 bp, Homo sapiens
ctgacagcctccacccactccttc

SEQ ID NO: 27561 - DNA, 24 bp, Homo sapiens
gtgtctttaaggttcaagagagat

SEQ ID NO: 27562 - DNA, 24 bp, Homo sapiens
tgtgtctttaaggttcaagagaga

SEQ ID NO: 27563 - DNA, 24 bp, Homo sapiens
ttgtgtctttaaggttcaagagag

SEQ ID NO: 27564 - DNA, 24 bp, Homo sapiens
tgccaaagaatgtaagataacacc

SEQ ID NO: 27565 - DNA, 24 bp, Homo sapiens
ctgccaaagaatgtaagataacac

SEQ ID NO: 27566 - DNA, 24 bp, Homo sapiens
cctgccaaagaatgtaagataaca

SEQ ID NO: 27567 - DNA, 24 bp, Homo sapiens
ttctattacagatgacttgtttaa

SEQ ID NO: 27568 - DNA, 24 bp, Homo sapiens
tttctattacagatgacttgttta

SEQ ID NO: 27569 - DNA, 24 bp, Homo sapiens
ttttctattacagatgacttgttt

SEQ ID NO: 27570 - DNA, 24 bp, Homo sapiens
ctttattccagaaatgaaagctca

SEQ ID NO: 27571 - DNA, 24 bp, Homo sapiens
actttattccagaaatgaaagctc

SEQ ID NO: 27572 - DNA, 24 bp, Homo sapiens
tactttattccagaaatgaaagct

SEQ ID NO: 27573 - DNA, 24 bp, Homo sapiens
aagtgagacaaagcctagacatgg

SEQ ID NO: 27574 - DNA, 24 bp, Homo sapiens
taagtgagacaaagcctagacatg

SEQ ID NO: 27575 - DNA, 24 bp, Homo sapiens
ttaagtgagacaaagcctagacat

SEQ ID NO: 27576 - DNA, 24 bp, Homo sapiens
atttttttcaagaaaagaaagcaa

SEQ ID NO: 27577 - DNA, 24 bp, Homo sapiens
gatttttttcaagaaaagaaagca

SEQ ID NO: 27578 - DNA, 24 bp, Homo sapiens
ggatttttttcaagaaaagaaagc

SEQ ID NO: 27579 - DNA, 24 bp, Homo sapiens
ttgaaggaaaggtatggtaaatta

SEQ ID NO: 27580 - DNA, 24 bp, Homo sapiens
attgaaggaaaggtatggtaaatt

SEQ ID NO: 27581 - DNA, 24 bp, Homo sapiens
cattgaaggaaaggtatggtaaat

SEQ ID NO: 27582 - DNA, 24 bp, Homo sapiens
tggcttcaaagttctcccatttgt

SEQ ID NO: 27583 - DNA, 24 bp, Homo sapiens
ttggcttcaaagttctcccatttg

SEQ ID NO: 27584 - DNA, 24 bp, Homo sapiens
tttggcttcaaagttctcccattt

SEQ ID NO: 27585 - DNA, 23 bp, Homo sapiens
ctcggactgtgaggcaggcagaa

SEQ ID NO: 27586 - DNA, 25 bp, Homo sapiens
actatggatgctgggaaactggtga

SEQ ID NO: 27587 - DNA, 25 bp, Homo sapiens
ggcagaacccgagtatcctaaaggc

SEQ ID NO: 27588 - DNA, 24 bp, Homo sapiens
ggtggtggtggttctgcctgtaaa

SEQ ID NO: 27589 - DNA, 24 bp, Homo sapiens
tgaggaaccactcgggaggattgc

SEQ ID NO: 27590 - DNA, 24 bp, Homo sapiens
taacctgagtgtcccagagcagcg

SEQ ID NO: 27591 - DNA, 24 bp, Homo sapiens
cgagtccatacgcatgaaacgcta

SEQ ID NO: 27592 - DNA, 24 bp, Homo sapiens
gatcccatatcgaaccgtctctga

SEQ ID NO: 27593 - DNA, 24 bp, Homo sapiens
cactcggctgggctggacaccatg

SEQ ID NO: 27594 - DNA, 24 bp, Homo sapiens
atacaacaagagtaattaaagctg

SEQ ID NO: 27595 - DNA, 24 bp, Homo sapiens
tatacaacaagagtaattaaagct

SEQ ID NO: 27596 - DNA, 24 bp, Homo sapiens
ttatacaacaagagtaattaaagc

SEQ ID NO: 27597 - DNA, 24 bp, Homo sapiens
ttctttatgatgtaagttatcttt

SEQ ID NO: 27598 - DNA, 24 bp, Homo sapiens
tttctttatgatgtaagttatctt

SEQ ID NO: 27599 - DNA, 24 bp, Homo sapiens
gtttctttatgatgtaagttatct

SEQ ID NO: 27600 - DNA, 25 bp, Homo sapiens
caccacctggctgctattagtctga

SEQ ID NO: 27601 - DNA, 25 bp, Homo sapiens
tgacttatgggaggtttggaatggc

SEQ ID NO: 27602 - DNA, 23 bp, Homo sapiens
atcactgttgctggaattgcgtt

SEQ ID NO: 27603 - DNA, 24 bp, Homo sapiens
tttcgtgtctcttcgggatttgcg

SEQ ID NO: 27604 - DNA, 24 bp, Homo sapiens
ggcgaaccatggctgggattttct

SEQ ID NO: 27605 - DNA, 24 bp, Homo sapiens
gatagaagcggcaggagcagcgtt

SEQ ID NO: 27606 - DNA, 24 bp, Homo sapiens
acaacactgagaataaggatctga

SEQ ID NO: 27607 - DNA, 24 bp, Homo sapiens
tacaacactgagaataaggatctg

SEQ ID NO: 27608 - DNA, 24 bp, Homo sapiens
atacaacactgagaataaggatct

SEQ ID NO: 27609 - DNA, 24 bp, Homo sapiens
caaatcaagatgtaggtgttacat

SEQ ID NO: 27610 - DNA, 24 bp, Homo sapiens
tcaaatcaagatgtaggtgttaca

SEQ ID NO: 27611 - DNA, 24 bp, Homo sapiens
gtcaaatcaagatgtaggtgttac

SEQ ID NO: 27612 - DNA, 24 bp, Homo sapiens
gcgaaaggataccgagaagccacc

SEQ ID NO: 27613 - DNA, 24 bp, Homo sapiens
ttatctactactgctcctcctggc

SEQ ID NO: 27614 - DNA, 24 bp, Homo sapiens
gctgctgcctcggcttggtctcgg

SEQ ID NO: 27615 - DNA, 25 bp, Homo sapiens
tggctccagcttgtgatcttaacct

SEQ ID NO: 27616 - DNA, 25 bp, Homo sapiens
gaacttgcccaaggtcacagaggtc

SEQ ID NO: 27617 - DNA, 24 bp, Homo sapiens
actagagccaggatttgaacccaa

SEQ ID NO: 27618 - DNA, 24 bp, Homo sapiens
tttgttataaagtagtgtttaaaa

SEQ ID NO: 27619 - DNA, 24 bp, Homo sapiens
gtttgttataaagtagtgtttaaa

SEQ ID NO: 27620 - DNA, 24 bp, Homo sapiens
tgtttgttataaagtagtgtttaa

SEQ ID NO: 27621 - DNA, 25 bp, Homo sapiens
gaagtccaagatcaaggtgtcagcc

SEQ ID NO: 27622 - DNA, 24 bp, Homo sapiens
gccagtgattgcacaaggaccagc

SEQ ID NO: 27623 - DNA, 25 bp, Homo sapiens
ttgctggaagtataggtgttctggc

SEQ ID NO: 27624 - DNA, 23 bp, Homo sapiens
agtgctgcctgagatgctgcttc

SEQ ID NO: 27625 - DNA, 24 bp, Homo sapiens
gaattatacaagtgagtgtgcttc

SEQ ID NO: 27626 - DNA, 24 bp, Homo sapiens
tgaattatacaagtgagtgtgctt

SEQ ID NO: 27627 - DNA, 24 bp, Homo sapiens
ttgaattatacaagtgagtgtgct

SEQ ID NO: 27628 - DNA, 24 bp, Homo sapiens
ggtagctgcgtggtggatgccgtc

SEQ ID NO: 27629 - DNA, 24 bp, Homo sapiens
agctgactgtgaacctgactcgat

SEQ ID NO: 27630 - DNA, 24 bp, Homo sapiens
ggaaggtgaatgtcaagacgctgc

SEQ ID NO: 27631 - DNA, 24 bp, Homo sapiens
aaaaaaaaagggaagcaagcttag

SEQ ID NO: 27632 - DNA, 24 bp, Homo sapiens
aaaaaaaaaagggaagcaagctta

SEQ ID NO: 27633 - DNA, 24 bp, Homo sapiens
aaaaaaaaaaagggaagcaagctt

SEQ ID NO: 27634 - DNA, 24 bp, Homo sapiens
gtgagaacgtggagcctggtggac

SEQ ID NO: 27635 - DNA, 24 bp, Homo sapiens
tgtgcaattgtcagaaggccgtgg

SEQ ID NO: 27636 - DNA, 24 bp, Homo sapiens
ccacagctctctttcccaaggagt

SEQ ID NO: 27637 - DNA, 25 bp, Homo sapiens
aaatcctccaatccctgaagtctgt

SEQ ID NO: 27638 - DNA, 23 bp, Homo sapiens
tgtcgcactcagccaacattcct

SEQ ID NO: 27639 - DNA, 25 bp, Homo sapiens
cctgacctcaagtgatctgcctacc

SEQ ID NO: 27640 - DNA, 24 bp, Homo sapiens
tcttccatcagaaataaaagaaga

SEQ ID NO: 27641 - DNA, 24 bp, Homo sapiens
ttcttccatcagaaataaaagaag

SEQ ID NO: 27642 - DNA, 24 bp, Homo sapiens
tttcttccatcagaaataaaagaa

SEQ ID NO: 27643 - DNA, 24 bp, Homo sapiens
ggagtccagtggtgtgatctcggc

SEQ ID NO: 27644 - DNA, 24 bp, Homo sapiens
tggagtccagtggtgtgatctcgg

SEQ ID NO: 27645 - DNA, 24 bp, Homo sapiens
ctggagtccagtggtgtgatctcg

SEQ ID NO: 27646 - DNA, 24 bp, Homo sapiens
aataaatacaagtaagtatatctc

SEQ ID NO: 27647 - DNA, 24 bp, Homo sapiens
aaataaatacaagtaagtatatct

SEQ ID NO: 27648 - DNA, 24 bp, Homo sapiens
gaaataaatacaagtaagtatatc

SEQ ID NO: 27649 - DNA, 24 bp, Homo sapiens
ttttatcacaggtgatcctttcaa

SEQ ID NO: 27650 - DNA, 24 bp, Homo sapiens
attttatcacaggtgatcctttca

SEQ ID NO: 27651 - DNA, 24 bp, Homo sapiens
tattttatcacaggtgatcctttc

SEQ ID NO: 27652 - DNA, 24 bp, Homo sapiens
acttcagtgctgtaagtactgtga

SEQ ID NO: 27653 - DNA, 24 bp, Homo sapiens
aacttcagtgctgtaagtactgtg

SEQ ID NO: 27654 - DNA, 24 bp, Homo sapiens
caacttcagtgctgtaagtactgt

SEQ ID NO: 27655 - DNA, 24 bp, Homo sapiens
tggaaaaatcggtagaaacgttga

SEQ ID NO: 27656 - DNA, 24 bp, Homo sapiens
ttggaaaaatcggtagaaacgttg

SEQ ID NO: 27657 - DNA, 24 bp, Homo sapiens
tttggaaaaatcggtagaaacgtt

SEQ ID NO: 27658 - DNA, 24 bp, Homo sapiens
gtgagtaaaaggtaagaaggaaag

SEQ ID NO: 27659 - DNA, 24 bp, Homo sapiens
tgtgagtaaaaggtaagaaggaaa

SEQ ID NO: 27660 - DNA, 24 bp, Homo sapiens
ctgtgagtaaaaggtaagaaggaa

SEQ ID NO: 27661 - DNA, 24 bp, Homo sapiens
aactcccaagagtaagtatgttta

SEQ ID NO: 27662 - DNA, 24 bp, Homo sapiens
aaactcccaagagtaagtatgttt

SEQ ID NO: 27663 - DNA, 24 bp, Homo sapiens
taaactcccaagagtaagtatgtt

SEQ ID NO: 27664 - DNA, 24 bp, Homo sapiens
cattattaaagaatatcactggaa

SEQ ID NO: 27665 - DNA, 24 bp, Homo sapiens
tcattattaaagaatatcactgga

SEQ ID NO: 27666 - DNA, 24 bp, Homo sapiens
ctcattattaaagaatatcactgg

SEQ ID NO: 27667 - DNA, 24 bp, Homo sapiens
aatagcacaacatggttccagacc

SEQ ID NO: 27668 - DNA, 24 bp, Homo sapiens
caatagcacaacatggttccagac

SEQ ID NO: 27669 - DNA, 24 bp, Homo sapiens
gcaatagcacaacatggttccaga

SEQ ID NO: 27670 - DNA, 25 bp, Homo sapiens
ttaaggatgagaagaccagtgtggc

SEQ ID NO: 27671 - DNA, 24 bp, Homo sapiens
tcagaggcagaggcaagaagaggt

SEQ ID NO: 27672 - DNA, 25 bp, Homo sapiens
atgatggataaactggctaacaccc

SEQ ID NO: 27673 - DNA, 25 bp, Homo sapiens
attatagccgaggaggtgtctgtgt

SEQ ID NO: 27674 - DNA, 23 bp, Homo sapiens
gtggcagagggcaaagtgtgtga

SEQ ID NO: 27675 - DNA, 25 bp, Homo sapiens
acggaagagcgactagacatcaagc

SEQ ID NO: 27676 - DNA, 25 bp, Homo sapiens
gcctccacttcacacttcacttctc

SEQ ID NO: 27677 - DNA, 25 bp, Homo sapiens
tcaagtgattctcctgcctgagcct

SEQ ID NO: 27678 - DNA, 25 bp, Homo sapiens
gcaatgacatgatctcggctcactg

SEQ ID NO: 27679 - DNA, 24 bp, Homo sapiens
tggtgcatcagaggctgtggccag

SEQ ID NO: 27680 - DNA, 24 bp, Homo sapiens
ctggtgcatcagaggctgtggcca

SEQ ID NO: 27681 - DNA, 24 bp, Homo sapiens
gctggtgcatcagaggctgtggcc

SEQ ID NO: 27682 - DNA, 24 bp, Homo sapiens
gtcactcagacctcctggctctcc

SEQ ID NO: 27683 - DNA, 24 bp, Homo sapiens
aatctgtggaggttgctggtacac

SEQ ID NO: 27684 - DNA, 25 bp, Homo sapiens
agcaaagaactcttaccctggcaaa

SEQ ID NO: 27685 - DNA, 23 bp, Homo sapiens
ccacagccacgactggagatgga

SEQ ID NO: 27686 - DNA, 25 bp, Homo sapiens
tccttccaagccctatccacacatt

SEQ ID NO: 27687 - DNA, 24 bp, Homo sapiens
ccagccgtctacacagcctactca

SEQ ID NO: 27688 - DNA, 24 bp, Homo sapiens
agtgtgctgaggtctggtgcccta

SEQ ID NO: 27689 - DNA, 24 bp, Homo sapiens
cagtgtgctgaggtctggtgccct

SEQ ID NO: 27690 - DNA, 24 bp, Homo sapiens
ccagtgtgctgaggtctggtgccc

SEQ ID NO: 27691 - DNA, 24 bp, Homo sapiens
aaactcataagatctaccgtataa

SEQ ID NO: 27692 - DNA, 24 bp, Homo sapiens
aaaactcataagatctaccgtata

SEQ ID NO: 27693 - DNA, 24 bp, Homo sapiens
aaaaactcataagatctaccgtat

SEQ ID NO: 27694 - DNA, 24 bp, Homo sapiens
cttgataaaaggaagtttcattga

SEQ ID NO: 27695 - DNA, 24 bp, Homo sapiens
tcttgataaaaggaagtttcattg

SEQ ID NO: 27696 - DNA, 24 bp, Homo sapiens
atcttgataaaaggaagtttcatt

SEQ ID NO: 27697 - DNA, 24 bp, Homo sapiens
agtataataaggaacaacagctaa

SEQ ID NO: 27698 - DNA, 24 bp, Homo sapiens
aagtataataaggaacaacagcta

SEQ ID NO: 27699 - DNA, 24 bp, Homo sapiens
gaagtataataaggaacaacagct

SEQ ID NO: 27700 - DNA, 24 bp, Homo sapiens
gctgctcaaccatctccttccaca

SEQ ID NO: 27701 - DNA, 25 bp, Homo sapiens
tgaagaccagcgtcctcagttagat

SEQ ID NO: 27702 - DNA, 23 bp, Homo sapiens
ttggaccaacaagtagccgcctt

SEQ ID NO: 27703 - DNA, 24 bp, Homo sapiens
tttttacccctaactttttactta

SEQ ID NO: 27704 - DNA, 24 bp, Homo sapiens
ttttttacccctaactttttactt

SEQ ID NO: 27705 - DNA, 24 bp, Homo sapiens
gttttttacccctaactttttact

SEQ ID NO: 27706 - DNA, 24 bp, Homo sapiens
tctgtgtcaaggtgaagccaaatg

SEQ ID NO: 27707 - DNA, 24 bp, Homo sapiens
ttctgtgtcaaggtgaagccaaat

SEQ ID NO: 27708 - DNA, 24 bp, Homo sapiens
cttctgtgtcaaggtgaagccaaa

SEQ ID NO: 27709 - DNA, 24 bp, Homo sapiens
gtcctcgctgttcctcaagcagaa

SEQ ID NO: 27710 - DNA, 24 bp, Homo sapiens
cacttcatggacgaggctgacctg

SEQ ID NO: 27711 - DNA, 24 bp, Homo sapiens
tggaggacaagtggaactcacgga

SEQ ID NO: 27712 - DNA, 24 bp, Homo sapiens
ggccctttccgggatgcagctaag

SEQ ID NO: 27713 - DNA, 24 bp, Homo sapiens
tggccctttccgggatgcagctaa

SEQ ID NO: 27714 - DNA, 24 bp, Homo sapiens
atggccctttccgggatgcagcta

SEQ ID NO: 27715 - DNA, 24 bp, Homo sapiens
ctgctcagagggctgctgaacagg

SEQ ID NO: 27716 - DNA, 24 bp, Homo sapiens
gctgctcagagggctgctgaacag

SEQ ID NO: 27717 - DNA, 24 bp, Homo sapiens
ggctgctcagagggctgctgaaca

SEQ ID NO: 27718 - DNA, 24 bp, Homo sapiens
ctgctgctgacactgccgctgctg

SEQ ID NO: 27719 - DNA, 24 bp, Homo sapiens
ccgtgcagcacttctatagcgtca

SEQ ID NO: 27720 - DNA, 24 bp, Homo sapiens
cactgctcaggctggataccacct

SEQ ID NO: 27721 - DNA, 24 bp, Homo sapiens
ggcttgccttgatccaggtgcttt

SEQ ID NO: 27722 - DNA, 24 bp, Homo sapiens
gatgttgtaatagttggtgcaggc

SEQ ID NO: 27723 - DNA, 24 bp, Homo sapiens
gggctctctgcagctgttcgtcta

SEQ ID NO: 27724 - DNA, 24 bp, Homo sapiens
ttcctccagagactgacgagtgcg

SEQ ID NO: 27725 - DNA, 24 bp, Homo sapiens
cgagcagccaccgtcccgaccaag

SEQ ID NO: 27726 - DNA, 24 bp, Homo sapiens
ctccagctcagagctcccggagcc

SEQ ID NO: 27727 - DNA, 24 bp, Homo sapiens
gatggctcctccaacccgtctctg

SEQ ID NO: 27728 - DNA, 24 bp, Homo sapiens
ctctccttccagcagtctggggag

SEQ ID NO: 27729 - DNA, 24 bp, Homo sapiens
aaagcaggctgttttgccacacca

SEQ ID NO: 27730 - DNA, 24 bp, Homo sapiens
caccatccggagccaataccgaga

SEQ ID NO: 27731 - DNA, 24 bp, Homo sapiens
attactctgtcgtgctgctgctga

SEQ ID NO: 27732 - DNA, 24 bp, Homo sapiens
gcagaagactatctatccgtggtc

SEQ ID NO: 27733 - DNA, 24 bp, Homo sapiens
gcacagaatccttggtgaacaggc

SEQ ID NO: 27734 - DNA, 24 bp, Homo sapiens
tcagcagtgtccatttgaagatca

SEQ ID NO: 27735 - DNA, 24 bp, Homo sapiens
agccttggtgttgattgcctttgc

SEQ ID NO: 27736 - DNA, 24 bp, Homo sapiens
acaagagtgaggttgctcatcggt

SEQ ID NO: 27737 - DNA, 23 bp, Homo sapiens
ctggcagtggcggctggcgattc

SEQ ID NO: 27738 - DNA, 23 bp, Homo sapiens
gcggtgctcggactcctcctgtc

SEQ ID NO: 27739 - DNA, 23 bp, Homo sapiens
catttcactgcggagcctgagcg

SEQ ID NO: 27740 - DNA, 24 bp, Homo sapiens
agtcgtgtgctgaggtgtaatgct

SEQ ID NO: 27741 - DNA, 24 bp, Homo sapiens
gttggcaaaggcatcataagaagc

SEQ ID NO: 27742 - DNA, 24 bp, Homo sapiens
aaagtctgtctgattccagggtgt

SEQ ID NO: 27743 - DNA, 24 bp, Homo sapiens
catataaatagcacatataacttt

SEQ ID NO: 27744 - DNA, 24 bp, Homo sapiens
gcatataaatagcacatataactt

SEQ ID NO: 27745 - DNA, 24 bp, Homo sapiens
tgcatataaatagcacatataact

SEQ ID NO: 27746 - DNA, 24 bp, Homo sapiens
tcataaaccaagcaagtatttgtc

SEQ ID NO: 27747 - DNA, 24 bp, Homo sapiens
gtcataaaccaagcaagtatttgt

SEQ ID NO: 27748 - DNA, 24 bp, Homo sapiens
cgtcataaaccaagcaagtatttg

SEQ ID NO: 27749 - DNA, 24 bp, Homo sapiens
tttcatttcagtaagtattccaga

SEQ ID NO: 27750 - DNA, 24 bp, Homo sapiens
ttttcatttcagtaagtattccag

SEQ ID NO: 27751 - DNA, 24 bp, Homo sapiens
tttttcatttcagtaagtattcca

SEQ ID NO: 27752 - DNA, 24 bp, Homo sapiens
tttcatttcagagataaaaatcat

SEQ ID NO: 27753 - DNA, 24 bp, Homo sapiens
ttttcatttcagagataaaaatca

SEQ ID NO: 27754 - DNA, 24 bp, Homo sapiens
tttttcatttcagagataaaaatc

SEQ ID NO: 27755 - DNA, 24 bp, Homo sapiens
agtgaagatttactgtcattgttt

SEQ ID NO: 27756 - DNA, 24 bp, Homo sapiens
aataaatgtgaacatttgcttggt

SEQ ID NO: 27757 - DNA, 24 bp, Homo sapiens
gtacttacaaaatagtatgtcact

SEQ ID NO: 27758 - DNA, 24 bp, Homo sapiens
tttatttccagtttgaatctttct

SEQ ID NO: 27759 - DNA, 24 bp, Homo sapiens
ttttatttccagtttgaatctttc

SEQ ID NO: 27760 - DNA, 24 bp, Homo sapiens
attttatttccagtttgaatcttt

SEQ ID NO: 27761 - DNA, 24 bp, Homo sapiens
cttggatccaggtttgtcttaata

SEQ ID NO: 27762 - DNA, 24 bp, Homo sapiens
ccttggatccaggtttgtcttaat

SEQ ID NO: 27763 - DNA, 24 bp, Homo sapiens
accttggatccaggtttgtcttaa

SEQ ID NO: 27764 - DNA, 23 bp, Homo sapiens
agtgatctcggtgagctgcctgt

SEQ ID NO: 27765 - DNA, 23 bp, Homo sapiens
ttccattcaacacctcagtcgtg

SEQ ID NO: 27766 - DNA, 24 bp, Homo sapiens
ggtcctaccatccaggctgaggtt

SEQ ID NO: 27767 - DNA, 25 bp, Homo sapiens
gaggctctgggattatgggatgagt

SEQ ID NO: 27768 - DNA, 25 bp, Homo sapiens
aaacccaccagtcttgaaacgccat

SEQ ID NO: 27769 - DNA, 25 bp, Homo sapiens
ctgggcaaagcaaggtaggactgaa

SEQ ID NO: 27770 - DNA, 24 bp, Homo sapiens
agttgtcgcaggtgaacataatat

SEQ ID NO: 27771 - DNA, 24 bp, Homo sapiens
cagttgtcgcaggtgaacataata

SEQ ID NO: 27772 - DNA, 24 bp, Homo sapiens
acagttgtcgcaggtgaacataat

SEQ ID NO: 27773 - DNA, 25 bp, Homo sapiens
acagcaacatcgacagtgtcatggc

SEQ ID NO: 27774 - DNA, 25 bp, Homo sapiens
gagaagaactggatattgttgctgc

SEQ ID NO: 27775 - DNA, 23 bp, Homo sapiens
accaatgccgtccgctgccagtt

SEQ ID NO: 27776 - DNA, 24 bp, Homo sapiens
gtcctcctccacctctgcccataa

SEQ ID NO: 27777 - DNA, 24 bp, Homo sapiens
acccagaatctcctgtatgcgaag

SEQ ID NO: 27778 - DNA, 24 bp, Homo sapiens
aacctatgaagaaggagatgtcgt

SEQ ID NO: 27779 - DNA, 24 bp, Homo sapiens
ggaaaaaatgggtgttaatatagt

SEQ ID NO: 27780 - DNA, 24 bp, Homo sapiens
tggaaaaaatgggtgttaatatag

SEQ ID NO: 27781 - DNA, 24 bp, Homo sapiens
atggaaaaaatgggtgttaatata

SEQ ID NO: 27782 - DNA, 24 bp, Homo sapiens
caaccagcagcccgaggtcttctg

SEQ ID NO: 27783 - DNA, 24 bp, Homo sapiens
ctcttgtcagccgccgccacccag

SEQ ID NO: 27784 - DNA, 24 bp, Homo sapiens
ctcggtccgctcgctgtccgctag

SEQ ID NO: 27785 - DNA, 24 bp, Homo sapiens
tttgccagcgatttcctctcccct

SEQ ID NO: 27786 - DNA, 24 bp, Homo sapiens
gtttgccagcgatttcctctcccc

SEQ ID NO: 27787 - DNA, 24 bp, Homo sapiens
agtttgccagcgatttcctctccc

SEQ ID NO: 27788 - DNA, 25 bp, Homo sapiens
atacaagcacagtttcacctccagc

SEQ ID NO: 27789 - DNA, 24 bp, Homo sapiens
ccttcctgcatgttgctgtggaca

SEQ ID NO: 27790 - DNA, 23 bp, Homo sapiens
gaagctggtccagctcttcgtgg

SEQ ID NO: 27791 - DNA, 24 bp, Homo sapiens
tttagcatatggtaagaatcaaaa

SEQ ID NO: 27792 - DNA, 24 bp, Homo sapiens
ttttagcatatggtaagaatcaaa

SEQ ID NO: 27793 - DNA, 24 bp, Homo sapiens
attttagcatatggtaagaatcaa

SEQ ID NO: 27794 - DNA, 24 bp, Homo sapiens
agatttttcagatttaatgtgtgc

SEQ ID NO: 27795 - DNA, 24 bp, Homo sapiens
gagatttttcagatttaatgtgtg

SEQ ID NO: 27796 - DNA, 24 bp, Homo sapiens
agagatttttcagatttaatgtgt

SEQ ID NO: 27797 - DNA, 24 bp, Homo sapiens
agttattgaagtgtgtaatgctgt

SEQ ID NO: 27798 - DNA, 24 bp, Homo sapiens
cagttattgaagtgtgtaatgctg

SEQ ID NO: 27799 - DNA, 24 bp, Homo sapiens
acagttattgaagtgtgtaatgct

SEQ ID NO: 27800 - DNA, 24 bp, Homo sapiens
aagaaaaccttaattcagcttaga

SEQ ID NO: 27801 - DNA, 24 bp, Homo sapiens
aaagaaaaccttaattcagcttag

SEQ ID NO: 27802 - DNA, 24 bp, Homo sapiens
caaagaaaaccttaattcagctta

SEQ ID NO: 27803 - DNA, 24 bp, Homo sapiens
gaagaaactaggttttgacacaag

SEQ ID NO: 27804 - DNA, 24 bp, Homo sapiens
agaagaaactaggttttgacacaa

SEQ ID NO: 27805 - DNA, 24 bp, Homo sapiens
gagaagaaactaggttttgacaca

SEQ ID NO: 27806 - DNA, 24 bp, Homo sapiens
gaaacctataggtaattttgttgg

SEQ ID NO: 27807 - DNA, 24 bp, Homo sapiens
agaaacctataggtaattttgttg

SEQ ID NO: 27808 - DNA, 24 bp, Homo sapiens
aagaaacctataggtaattttgtt

SEQ ID NO: 27809 - DNA, 24 bp, Homo sapiens
ctaattcaagtgtatgtaatattt

SEQ ID NO: 27810 - DNA, 24 bp, Homo sapiens
gctaattcaagtgtatgtaatatt

SEQ ID NO: 27811 - DNA, 24 bp, Homo sapiens
tgctaattcaagtgtatgtaatat

SEQ ID NO: 27812 - DNA, 24 bp, Homo sapiens
gagttggcggctgagctgggcatg

SEQ ID NO: 27813 - DNA, 24 bp, Homo sapiens
gaaggagtcatggcggatggtcag

SEQ ID NO: 27814 - DNA, 24 bp, Homo sapiens
gcggtggtgggcgccgtgaagagc

SEQ ID NO: 27815 - DNA, 24 bp, Homo sapiens
ttgtaattgatgtaagtaaaatat

SEQ ID NO: 27816 - DNA, 24 bp, Homo sapiens
tttgtaattgatgtaagtaaaata

SEQ ID NO: 27817 - DNA, 24 bp, Homo sapiens
gtttgtaattgatgtaagtaaaat

SEQ ID NO: 27818 - DNA, 24 bp, Homo sapiens
acctggtcttgaactccttggcgg

SEQ ID NO: 27819 - DNA, 24 bp, Homo sapiens
cttggctacgcacggtcgcttcct

SEQ ID NO: 27820 - DNA, 24 bp, Homo sapiens
gctcggcatggctatcttcctgaa

SEQ ID NO: 27821 - DNA, 24 bp, Homo sapiens
cttggctacgcacggtcgcttcct

SEQ ID NO: 27822 - DNA, 24 bp, Homo sapiens
acctggtcttgaactccttggcgg

SEQ ID NO: 27823 - DNA, 24 bp, Homo sapiens
gatgtgccttccaactggacgctg

SEQ ID NO: 27824 - DNA, 24 bp, Homo sapiens
tttcataacaggtaaaaaaaattc

SEQ ID NO: 27825 - DNA, 24 bp, Homo sapiens
atttcataacaggtaaaaaaaatt

SEQ ID NO: 27826 - DNA, 24 bp, Homo sapiens
tatttcataacaggtaaaaaaaat

SEQ ID NO: 27827 - DNA, 24 bp, Homo sapiens
gcggctcgtgcggcaggtaccatg

SEQ ID NO: 27828 - DNA, 24 bp, Homo sapiens
gagacggcgggtgagctccacgag

SEQ ID NO: 27829 - DNA, 24 bp, Homo sapiens
cggcaggcccggtccctgctcggg

SEQ ID NO: 27830 - DNA, 24 bp, Homo sapiens
acagcgactccatccagaagccta

SEQ ID NO: 27831 - DNA, 24 bp, Homo sapiens
acctaaagacaagcacctgggacc

SEQ ID NO: 27832 - DNA, 24 bp, Homo sapiens
tggtggtggtgtttgttctctgcc

SEQ ID NO: 27833 - DNA, 24 bp, Homo sapiens
tttatcatttgattcacttttttc

SEQ ID NO: 27834 - DNA, 24 bp, Homo sapiens
gtttatcatttgattcactttttt

SEQ ID NO: 27835 - DNA, 24 bp, Homo sapiens
agtttatcatttgattcacttttt

SEQ ID NO: 27836 - DNA, 24 bp, Homo sapiens
acagacatcgctatccaagtggct

SEQ ID NO: 27837 - DNA, 24 bp, Homo sapiens
ataacccaccgagattcttccagc

SEQ ID NO: 27838 - DNA, 24 bp, Homo sapiens
gatggatggctggtgactgctgag

SEQ ID NO: 27839 - DNA, 24 bp, Homo sapiens
ttcaattttaggtacatatccatt

SEQ ID NO: 27840 - DNA, 24 bp, Homo sapiens
attcaattttaggtacatatccat

SEQ ID NO: 27841 - DNA, 24 bp, Homo sapiens
aattcaattttaggtacatatcca

SEQ ID NO: 27842 - DNA, 24 bp, Homo sapiens
gtgatggtctgtgctggtgacgag

SEQ ID NO: 27843 - DNA, 25 bp, Homo sapiens
gctgctacgctccaagaatgatgaa

SEQ ID NO: 27844 - DNA, 23 bp, Homo sapiens
gctctcgctgtcaccgcaactgc

SEQ ID NO: 27845 - DNA, 24 bp, Homo sapiens
cggtgctgcctggctggttgctct

SEQ ID NO: 27846 - DNA, 24 bp, Homo sapiens
ccggtgctgcctggctggttgctc

SEQ ID NO: 27847 - DNA, 24 bp, Homo sapiens
gccggtgctgcctggctggttgct

SEQ ID NO: 27848 - DNA, 25 bp, Homo sapiens
tccacgaagactaatgatgttgagc

SEQ ID NO: 27849 - DNA, 24 bp, Homo sapiens
atggcttcacaagatgacggctgg

SEQ ID NO: 27850 - DNA, 25 bp, Homo sapiens
agagtcttgctatgttgtccaggct

SEQ ID NO: 27851 - DNA, 24 bp, Homo sapiens
atggcttcacaagatgacggctgg

SEQ ID NO: 27852 - DNA, 25 bp, Homo sapiens
agagtcttgctatgttgtccaggct

SEQ ID NO: 27853 - DNA, 24 bp, Homo sapiens
gctctttcacactcaggctcttcc

SEQ ID NO: 27854 - DNA, 23 bp, Homo sapiens
atgacggctgggctcctgggctg

SEQ ID NO: 27855 - DNA, 25 bp, Homo sapiens
tgaagaatgagatacatgtacagtt

SEQ ID NO: 27856 - DNA, 23 bp, Homo sapiens
ataaaaccaaagaataatggctt

SEQ ID NO: 27857 - DNA, 24 bp, Homo sapiens
tttataaaaaggagatggggtttt

SEQ ID NO: 27858 - DNA, 24 bp, Homo sapiens
ctttataaaaaggagatggggttt

SEQ ID NO: 27859 - DNA, 24 bp, Homo sapiens
tctttataaaaaggagatggggtt

SEQ ID NO: 27860 - DNA, 23 bp, Homo sapiens
tgggaggatggtgcggatcttgg

SEQ ID NO: 27861 - DNA, 24 bp, Homo sapiens
ccagccaccaagaggtagcattcc

SEQ ID NO: 27862 - DNA, 23 bp, Homo sapiens
gatgacgacccccgagtgaggac

SEQ ID NO: 27863 - DNA, 23 bp, Homo sapiens
agccagaggagccgccgcagtag

SEQ ID NO: 27864 - DNA, 23 bp, Homo sapiens
gggaccaggcccgaggctgagcg

SEQ ID NO: 27865 - DNA, 23 bp, Homo sapiens
cggtggccgggaggggggaggag

SEQ ID NO: 27866 - DNA, 25 bp, Homo sapiens
gtgtggctggctctcgctctatatt

SEQ ID NO: 27867 - DNA, 23 bp, Homo sapiens
gccacctgaataagcaccgaagc

SEQ ID NO: 27868 - DNA, 25 bp, Homo sapiens
cgcttatattggcttcattgatggc

SEQ ID NO: 27869 - DNA, 23 bp, Homo sapiens
tgaccacttaccgcagcatccaa

SEQ ID NO: 27870 - DNA, 23 bp, Homo sapiens
gtgggctgctggatggcggaacc

SEQ ID NO: 27871 - DNA, 23 bp, Homo sapiens
gcttgagcttctgagggtcgggt

SEQ ID NO: 27872 - DNA, 23 bp, Homo sapiens
gtgctggtggtgtctctggtgga

SEQ ID NO: 27873 - DNA, 23 bp, Homo sapiens
tgttcggaatgctgctgttcgct

SEQ ID NO: 27874 - DNA, 25 bp, Homo sapiens
acctacttccagaacctgcctgagt

SEQ ID NO: 27875 - DNA, 23 bp, Homo sapiens
tggaggtgctggtagatgcctgg

SEQ ID NO: 27876 - DNA, 25 bp, Homo sapiens
aacaggagatgaaagatgaccagga

SEQ ID NO: 27877 - DNA, 25 bp, Homo sapiens
accaacacttaccacatcttcacca

SEQ ID NO: 27878 - DNA, 24 bp, Homo sapiens
gcagatccaagaaggaaacttttc

SEQ ID NO: 27879 - DNA, 24 bp, Homo sapiens
tgcagatccaagaaggaaactttt

SEQ ID NO: 27880 - DNA, 24 bp, Homo sapiens
ttgcagatccaagaaggaaacttt

SEQ ID NO: 27881 - DNA, 24 bp, Homo sapiens
tctttccacagtgaaaataagttg

SEQ ID NO: 27882 - DNA, 24 bp, Homo sapiens
ttctttccacagtgaaaataagtt

SEQ ID NO: 27883 - DNA, 24 bp, Homo sapiens
gttctttccacagtgaaaataagt

SEQ ID NO: 27884 - DNA, 23 bp, Homo sapiens
caggcagaccagacgcagactgt

SEQ ID NO: 27885 - DNA, 24 bp, Homo sapiens
tctcctgtaagagtcctgctgggc

SEQ ID NO: 27886 - DNA, 25 bp, Homo sapiens
actctttcaatacacaagccagggt

SEQ ID NO: 27887 - DNA, 24 bp, Homo sapiens
acaatgtgaagatatagatgaatg

SEQ ID NO: 27888 - DNA, 24 bp, Homo sapiens
cacaatgtgaagatatagatgaat

SEQ ID NO: 27889 - DNA, 24 bp, Homo sapiens
acacaatgtgaagatatagatgaa

SEQ ID NO: 27890 - DNA, 24 bp, Homo sapiens
ttatgctgcagatttgcgaatgag

SEQ ID NO: 27891 - DNA, 24 bp, Homo sapiens
tttatgctgcagatttgcgaatga

SEQ ID NO: 27892 - DNA, 24 bp, Homo sapiens
atttatgctgcagatttgcgaatg

SEQ ID NO: 27893 - DNA, 24 bp, Homo sapiens
agcttgtcaagatattgatgaatg

SEQ ID NO: 27894 - DNA, 24 bp, Homo sapiens
gagcttgtcaagatattgatgaat

SEQ ID NO: 27895 - DNA, 24 bp, Homo sapiens
ggagcttgtcaagatattgatgaa

SEQ ID NO: 27896 - DNA, 23 bp, Homo sapiens
ggcgagtctgtcaccattcctgc

SEQ ID NO: 27897 - DNA, 24 bp, Homo sapiens
ctgccaagacactgacgaatgcct

SEQ ID NO: 27898 - DNA, 23 bp, Homo sapiens
aggtgggtttgtgtgcgagtgtg

SEQ ID NO: 27899 - DNA, 25 bp, Homo sapiens
agcgatacctgaccacctacaacca

SEQ ID NO: 27900 - DNA, 23 bp, Homo sapiens
ccacagggttcagccttaacaac

SEQ ID NO: 27901 - DNA, 23 bp, Homo sapiens
gagtcaccagcagtttcagccac

SEQ ID NO: 27902 - DNA, 24 bp, Homo sapiens
gtggtctcatgccaagccagtctg

SEQ ID NO: 27903 - DNA, 24 bp, Homo sapiens
ctacggtcgggaggatttcaagcc

SEQ ID NO: 27904 - DNA, 23 bp, Homo sapiens
ccctgaaattctacgccaccagc

SEQ ID NO: 27905 - DNA, 24 bp, Homo sapiens
agcaacatctgattttttggttgc

SEQ ID NO: 27906 - DNA, 24 bp, Homo sapiens
gagcaacatctgattttttggttg

SEQ ID NO: 27907 - DNA, 24 bp, Homo sapiens
cgagcaacatctgattttttggtt

SEQ ID NO: 27908 - DNA, 25 bp, Homo sapiens
ggtattacagaccacggtgtgaaca

SEQ ID NO: 27909 - DNA, 24 bp, Homo sapiens
gccttgatcctcctgccttagcct

SEQ ID NO: 27910 - DNA, 23 bp, Homo sapiens
gtcttgctctgtcacccaggctg

SEQ ID NO: 27911 - DNA, 25 bp, Homo sapiens
aagaacaatttccaccaatttaggt

SEQ ID NO: 27912 - DNA, 23 bp, Homo sapiens
ccatggtgcaatctcggctcact

SEQ ID NO: 27913 - DNA, 25 bp, Homo sapiens
gaaatctaataaagtgatatttcag

SEQ ID NO: 27914 - DNA, 24 bp, Homo sapiens
ctagactatcagtaagtttttatt

SEQ ID NO: 27915 - DNA, 24 bp, Homo sapiens
tctagactatcagtaagtttttat

SEQ ID NO: 27916 - DNA, 24 bp, Homo sapiens
ttctagactatcagtaagttttta

SEQ ID NO: 27917 - DNA, 24 bp, Homo sapiens
ggatggaagagatatcaatgaatg

SEQ ID NO: 27918 - DNA, 24 bp, Homo sapiens
tggatggaagagatatcaatgaat

SEQ ID NO: 27919 - DNA, 24 bp, Homo sapiens
gtggatggaagagatatcaatgaa

SEQ ID NO: 27920 - DNA, 24 bp, Homo sapiens
gggctgtacagatattgatgaatg

SEQ ID NO: 27921 - DNA, 24 bp, Homo sapiens
agggctgtacagatattgatgaat

SEQ ID NO: 27922 - DNA, 24 bp, Homo sapiens
cagggctgtacagatattgatgaa

SEQ ID NO: 27923 - DNA, 24 bp, Homo sapiens
ggtcagcatccacataatcgcaga

SEQ ID NO: 27924 - DNA, 23 bp, Homo sapiens
cgctggctgtggtgctgttcctg

SEQ ID NO: 27925 - DNA, 24 bp, Homo sapiens
gagtacggcgaagagcagatcctg

SEQ ID NO: 27926 - DNA, 24 bp, Homo sapiens
ttatagatatacatctacatctct

SEQ ID NO: 27927 - DNA, 24 bp, Homo sapiens
tttatagatatacatctacatctc

SEQ ID NO: 27928 - DNA, 24 bp, Homo sapiens
atttatagatatacatctacatct

SEQ ID NO: 27929 - DNA, 23 bp, Homo sapiens
tgctgctgctgctgccgctgctc

SEQ ID NO: 27930 - DNA, 23 bp, Homo sapiens
actttgggcgaagtttgcctgcg

SEQ ID NO: 27931 - DNA, 23 bp, Homo sapiens
ccctgctgagcgctacccacgtg

SEQ ID NO: 27932 - DNA, 24 bp, Homo sapiens
aagaatgctacatttcgaatagac

SEQ ID NO: 27933 - DNA, 24 bp, Homo sapiens
taagaatgctacatttcgaataga

SEQ ID NO: 27934 - DNA, 24 bp, Homo sapiens
ttaagaatgctacatttcgaatag

SEQ ID NO: 27935 - DNA, 23 bp, Homo sapiens
ggggcagggagggatctggctga

SEQ ID NO: 27936 - DNA, 23 bp, Homo sapiens
ctgtaccctgtgcgctcggagct

SEQ ID NO: 27937 - DNA, 23 bp, Homo sapiens
ccgagcgcccagaggtccccgcc

SEQ ID NO: 27938 - DNA, 23 bp, Homo sapiens
gtgatcctcgcacctcagcctcc

SEQ ID NO: 27939 - DNA, 23 bp, Homo sapiens
ggactcagcctcgacttcaccag

SEQ ID NO: 27940 - DNA, 25 bp, Homo sapiens
cgtagcgggaccgattgcctaatac

SEQ ID NO: 27941 - DNA, 24 bp, Homo sapiens
acatttctaagtgggagaagttgc

SEQ ID NO: 27942 - DNA, 24 bp, Homo sapiens
aacatttctaagtgggagaagttg

SEQ ID NO: 27943 - DNA, 24 bp, Homo sapiens
caacatttctaagtgggagaagtt

SEQ ID NO: 27944 - DNA, 24 bp, Homo sapiens
acgtggaccagagctccccaaacc

SEQ ID NO: 27945 - DNA, 24 bp, Homo sapiens
tacgtggaccagagctccccaaac

SEQ ID NO: 27946 - DNA, 24 bp, Homo sapiens
atacgtggaccagagctccccaaa

SEQ ID NO: 27947 - DNA, 24 bp, Homo sapiens
aagaacaaaatctctttttaaggt

SEQ ID NO: 27948 - DNA, 24 bp, Homo sapiens
gaagaacaaaatctctttttaagg

SEQ ID NO: 27949 - DNA, 24 bp, Homo sapiens
agaagaacaaaatctctttttaag

SEQ ID NO: 27950 - DNA, 24 bp, Homo sapiens
taatatgtatgggaggaataagtt

SEQ ID NO: 27951 - DNA, 24 bp, Homo sapiens
ataatatgtatgggaggaataagt

SEQ ID NO: 27952 - DNA, 24 bp, Homo sapiens
gataatatgtatgggaggaataag

SEQ ID NO: 27953 - DNA, 24 bp, Homo sapiens
gcgtctgcttgctcttattttagc

SEQ ID NO: 27954 - DNA, 24 bp, Homo sapiens
agcgtctgcttgctcttattttag

SEQ ID NO: 27955 - DNA, 24 bp, Homo sapiens
gagcgtctgcttgctcttatttta

SEQ ID NO: 27956 - DNA, 24 bp, Homo sapiens
gtgtatctcaagtgagtaaaaatc

SEQ ID NO: 27957 - DNA, 24 bp, Homo sapiens
ggtgtatctcaagtgagtaaaaat

SEQ ID NO: 27958 - DNA, 24 bp, Homo sapiens
tggtgtatctcaagtgagtaaaaa

SEQ ID NO: 27959 - DNA, 24 bp, Homo sapiens
gggcagagctggctggaatccagt

SEQ ID NO: 27960 - DNA, 24 bp, Homo sapiens
cgggcagagctggctggaatccag

SEQ ID NO: 27961 - DNA, 24 bp, Homo sapiens
gcgggcagagctggctggaatcca

SEQ ID NO: 27962 - DNA, 25 bp, Homo sapiens
tggtctgcttagattgttacaaggc

SEQ ID NO: 27963 - DNA, 25 bp, Homo sapiens
tgcttggatgaagtgtgtgaaggga

SEQ ID NO: 27964 - DNA, 25 bp, Homo sapiens
tggtgtatctcaatctcagcagcaa

SEQ ID NO: 27965 - DNA, 24 bp, Homo sapiens
agaacgctctgccactctaatggt

SEQ ID NO: 27966 - DNA, 24 bp, Homo sapiens
gcagtcagttgattgtcaccgcct

SEQ ID NO: 27967 - DNA, 23 bp, Homo sapiens
cacccaccagcccgtagcagatg

SEQ ID NO: 27968 - DNA, 23 bp, Homo sapiens
aagtacgcttcctcagttggcag

SEQ ID NO: 27969 - DNA, 25 bp, Homo sapiens
tctggaatagtgagcagtgaaggtg

SEQ ID NO: 27970 - DNA, 25 bp, Homo sapiens
aaacttgccttccccagactacttt

SEQ ID NO: 27971 - DNA, 24 bp, Homo sapiens
gtatgttttagtttcttcagatgg

SEQ ID NO: 27972 - DNA, 24 bp, Homo sapiens
tgtatgttttagtttcttcagatg

SEQ ID NO: 27973 - DNA, 24 bp, Homo sapiens
ttgtatgttttagtttcttcagat

SEQ ID NO: 27974 - DNA, 23 bp, Homo sapiens
gaaggagggagccaggaaacagc

SEQ ID NO: 27975 - DNA, 23 bp, Homo sapiens
cactctcaggtgctctgccgctg

SEQ ID NO: 27976 - DNA, 24 bp, Homo sapiens
tgactccttaacacgcatccacat

SEQ ID NO: 27977 - DNA, 23 bp, Homo sapiens
gtaactctgctgcctctgcctgc

SEQ ID NO: 27978 - DNA, 23 bp, Homo sapiens
cagcagccgccgtcaatgttcac

SEQ ID NO: 27979 - DNA, 25 bp, Homo sapiens
atcctaatttgggctatctgggtcc

SEQ ID NO: 27980 - DNA, 24 bp, Homo sapiens
tattctgtgaggtaagtaagattt

SEQ ID NO: 27981 - DNA, 24 bp, Homo sapiens
ttattctgtgaggtaagtaagatt

SEQ ID NO: 27982 - DNA, 24 bp, Homo sapiens
attattctgtgaggtaagtaagat

SEQ ID NO: 27983 - DNA, 24 bp, Homo sapiens
tttaaattgtgtattttgtgtcat

SEQ ID NO: 27984 - DNA, 24 bp, Homo sapiens
ttttaaattgtgtattttgtgtca

SEQ ID NO: 27985 - DNA, 24 bp, Homo sapiens
cttttaaattgtgtattttgtgtc

SEQ ID NO: 27986 - DNA, 24 bp, Homo sapiens
gaatctaaagagtgagtatggcca

SEQ ID NO: 27987 - DNA, 24 bp, Homo sapiens
agaatctaaagagtgagtatggcc

SEQ ID NO: 27988 - DNA, 24 bp, Homo sapiens
aagaatctaaagagtgagtatggc

SEQ ID NO: 27989 - DNA, 25 bp, Homo sapiens
agaggaaagagatgccaagactgcc

SEQ ID NO: 27990 - DNA, 25 bp, Homo sapiens
tgactgaaatgatccttcttctgct

SEQ ID NO: 27991 - DNA, 24 bp, Homo sapiens
aaagagaaaataaaaaatcgctac

SEQ ID NO: 27992 - DNA, 24 bp, Homo sapiens
gaaaagagaaggtataaaacaatg

SEQ ID NO: 27993 - DNA, 24 bp, Homo sapiens
agaaaagagaaggtataaaacaat

SEQ ID NO: 27994 - DNA, 24 bp, Homo sapiens
aagaaaagagaaggtataaaacaa

SEQ ID NO: 27995 - DNA, 24 bp, Homo sapiens
catttgcttaggaaagtgacaata

SEQ ID NO: 27996 - DNA, 24 bp, Homo sapiens
ccatttgcttaggaaagtgacaat

SEQ ID NO: 27997 - DNA, 24 bp, Homo sapiens
cccatttgcttaggaaagtgacaa

SEQ ID NO: 27998 - DNA, 25 bp, Homo sapiens
gaagtccaagatcaaggcactggca

SEQ ID NO: 27999 - DNA, 24 bp, Homo sapiens
ttcagtggctcacacctggaatcc

SEQ ID NO: 28000 - DNA, 24 bp, Homo sapiens
gcctggtcatctacattgtctgga

SEQ ID NO: 28001 - DNA, 24 bp, Homo sapiens
gctgcttcctcctgtactcagtgt

SEQ ID NO: 28002 - DNA, 24 bp, Homo sapiens
actaccacaataaatcagtcatca

SEQ ID NO: 28003 - DNA, 24 bp, Homo sapiens
gactaccacaataaatcagtcatc

SEQ ID NO: 28004 - DNA, 24 bp, Homo sapiens
ggactaccacaataaatcagtcat

SEQ ID NO: 28005 - DNA, 25 bp, Homo sapiens
ggtaggcaggcgaagaagaaagcaa

SEQ ID NO: 28006 - DNA, 25 bp, Homo sapiens
acagatgaggatgaagatggtggct

SEQ ID NO: 28007 - DNA, 23 bp, Homo sapiens
aaggcaggctgtacggcaacatg

SEQ ID NO: 28008 - DNA, 23 bp, Homo sapiens
cactctggctggaacggctcttg

SEQ ID NO: 28009 - DNA, 25 bp, Homo sapiens
ctgctcacagactcttggatgttga

SEQ ID NO: 28010 - DNA, 23 bp, Homo sapiens
ccctgctcctgcctcccacatta

SEQ ID NO: 28011 - DNA, 23 bp, Homo sapiens
ccctgctcctgcctcccacatta

SEQ ID NO: 28012 - DNA, 25 bp, Homo sapiens
ctgctcacagactcttggatgttga

SEQ ID NO: 28013 - DNA, 24 bp, Homo sapiens
ggaggatgatatagaccggcggcc

SEQ ID NO: 28014 - DNA, 24 bp, Homo sapiens
tgaggcaggagaatcgcttgaacc

SEQ ID NO: 28015 - DNA, 25 bp, Homo sapiens
ggtcttccaatctctgaggcttgct

SEQ ID NO: 28016 - DNA, 25 bp, Homo sapiens
caggaccttggtgcgtgttgaatga

SEQ ID NO: 28017 - DNA, 24 bp, Homo sapiens
ggagtggaaggagcccccctccat

SEQ ID NO: 28018 - DNA, 24 bp, Homo sapiens
tggagtggaaggagcccccctcca

SEQ ID NO: 28019 - DNA, 24 bp, Homo sapiens
ctggagtggaaggagcccccctcc

SEQ ID NO: 28020 - DNA, 24 bp, Homo sapiens
caggtacgaggagggcattgttgt

SEQ ID NO: 28021 - DNA, 24 bp, Homo sapiens
gaccgagcccgcagagcccctcct

SEQ ID NO: 28022 - DNA, 24 bp, Homo sapiens
gggccgggggtcgggaggagtcac

SEQ ID NO: 28023 - DNA, 24 bp, Homo sapiens
tcaccttcctgctattctcctgcc

SEQ ID NO: 28024 - DNA, 24 bp, Homo sapiens
ctatcagtcagcggtggcagcagc

SEQ ID NO: 28025 - DNA, 24 bp, Homo sapiens
tctgaggatcaaggagaagctctt

SEQ ID NO: 28026 - DNA, 24 bp, Homo sapiens
tcaccttcctgctattctcctgcc

SEQ ID NO: 28027 - DNA, 24 bp, Homo sapiens
ctatcagtcagcggtggcagcagc

SEQ ID NO: 28028 - DNA, 24 bp, Homo sapiens
aatttcgacctcaagcagggcacc

SEQ ID NO: 28029 - DNA, 24 bp, Homo sapiens
caaaatatcagagcaaataccgaa

SEQ ID NO: 28030 - DNA, 24 bp, Homo sapiens
tcaaaatatcagagcaaataccga

SEQ ID NO: 28031 - DNA, 24 bp, Homo sapiens
gtcaaaatatcagagcaaataccg

SEQ ID NO: 28032 - DNA, 24 bp, Homo sapiens
tttgttcacagaaaacaaaattat

SEQ ID NO: 28033 - DNA, 24 bp, Homo sapiens
ttttgttcacagaaaacaaaatta

SEQ ID NO: 28034 - DNA, 24 bp, Homo sapiens
tttttgttcacagaaaacaaaatt

SEQ ID NO: 28035 - DNA, 24 bp, Homo sapiens
tatatccatagatattctgcagcg

SEQ ID NO: 28036 - DNA, 24 bp, Homo sapiens
ttatatccatagatattctgcagc

SEQ ID NO: 28037 - DNA, 24 bp, Homo sapiens
attatatccatagatattctgcag

SEQ ID NO: 28038 - DNA, 23 bp, Homo sapiens
cttctccctcacctccagcagcg

SEQ ID NO: 28039 - DNA, 23 bp, Homo sapiens
ccttcgccaacgactactctgtt

SEQ ID NO: 28040 - DNA, 23 bp, Homo sapiens
cgccgccgcagccgccgcctcca

SEQ ID NO: 28041 - DNA, 23 bp, Homo sapiens
cctggacttgagcctgagcccgc

SEQ ID NO: 28042 - DNA, 23 bp, Homo sapiens
cccaagtcccgcaactccgagcc

SEQ ID NO: 28043 - DNA, 23 bp, Homo sapiens
gagtcagagctgaagtcggcgga

SEQ ID NO: 28044 - DNA, 24 bp, Homo sapiens
tctccctgcagttctcccgtgttc

SEQ ID NO: 28045 - DNA, 24 bp, Homo sapiens
gtctccctgcagttctcccgtgtt

SEQ ID NO: 28046 - DNA, 24 bp, Homo sapiens
ggtctccctgcagttctcccgtgt

SEQ ID NO: 28047 - DNA, 23 bp, Homo sapiens
tccgtactgccagtgagaccagc

SEQ ID NO: 28048 - DNA, 24 bp, Homo sapiens
tcagacctccagtcctcagcagtg

SEQ ID NO: 28049 - DNA, 25 bp, Homo sapiens
gctggaggagtggatggaatacgag

SEQ ID NO: 28050 - DNA, 25 bp, Homo sapiens
ccatcaagatccagttcacgtcgct

SEQ ID NO: 28051 - DNA, 24 bp, Homo sapiens
ggctcctccagttaccgctttgtg

SEQ ID NO: 28052 - DNA, 23 bp, Homo sapiens
gcgtcggagcagcaggcagacac

SEQ ID NO: 28053 - DNA, 24 bp, Homo sapiens
cgagtgctgtggtggattggcatt

SEQ ID NO: 28054 - DNA, 24 bp, Homo sapiens
gcgagtgctgtggtggattggcat

SEQ ID NO: 28055 - DNA, 24 bp, Homo sapiens
tgcgagtgctgtggtggattggca

SEQ ID NO: 28056 - DNA, 25 bp, Homo sapiens
ttagaaatgtcggattgtgtgaagc

SEQ ID NO: 28057 - DNA, 25 bp, Homo sapiens
ctgagtttcttcatctacaacccgc

SEQ ID NO: 28058 - DNA, 23 bp, Homo sapiens
cccaggagaagcagttcccgccg

SEQ ID NO: 28059 - DNA, 24 bp, Homo sapiens
tccacaatcagcaaagagcaaatc

SEQ ID NO: 28060 - DNA, 24 bp, Homo sapiens
gtccacaatcagcaaagagcaaat

SEQ ID NO: 28061 - DNA, 24 bp, Homo sapiens
agtccacaatcagcaaagagcaaa

SEQ ID NO: 28062 - DNA, 23 bp, Homo sapiens
ccctccgaccagaacagactgcg

SEQ ID NO: 28063 - DNA, 23 bp, Homo sapiens
gaggagaccagcagcagcacttg

SEQ ID NO: 28064 - DNA, 24 bp, Homo sapiens
gaagcctgatctctccaagtccgc

SEQ ID NO: 28065 - DNA, 23 bp, Homo sapiens
cttctgacctcaagtgatccgcc

SEQ ID NO: 28066 - DNA, 25 bp, Homo sapiens
ttattagcaggtgttcggatcgggc

SEQ ID NO: 28067 - DNA, 25 bp, Homo sapiens
agtaaccaatgaccgtcagattcca

SEQ ID NO: 28068 - DNA, 25 bp, Homo sapiens
gcaagcgtcctattccatactaccg

SEQ ID NO: 28069 - DNA, 23 bp, Homo sapiens
cttctgacctcaagtgatccgcc

SEQ ID NO: 28070 - DNA, 25 bp, Homo sapiens
ttattagcaggtgttcggatcgggc

SEQ ID NO: 28071 - DNA, 24 bp, Homo sapiens
gctgccccgaggtgggaaggagaa

SEQ ID NO: 28072 - DNA, 24 bp, Homo sapiens
cgctgccccgaggtgggaaggaga

SEQ ID NO: 28073 - DNA, 24 bp, Homo sapiens
ccgctgccccgaggtgggaaggag

SEQ ID NO: 28074 - DNA, 24 bp, Homo sapiens
cgacagactctaaggctctacaga

SEQ ID NO: 28075 - DNA, 24 bp, Homo sapiens
aagaaccaaccaattccggacaca

SEQ ID NO: 28076 - DNA, 24 bp, Homo sapiens
caggagccaccgaggccggacacg

SEQ ID NO: 28077 - DNA, 25 bp, Homo sapiens
acggtgtctttgatctatgctgtgc

SEQ ID NO: 28078 - DNA, 25 bp, Homo sapiens
aggagatggacaccaccactgacaa

SEQ ID NO: 28079 - DNA, 25 bp, Homo sapiens
aagtcaggctatgtcttctttgagt

SEQ ID NO: 28080 - DNA, 24 bp, Homo sapiens
tttagcaacctcagcagtgtgggc

SEQ ID NO: 28081 - DNA, 25 bp, Homo sapiens
tggcagggtcagatgattacacaaa

SEQ ID NO: 28082 - DNA, 25 bp, Homo sapiens
ccgagcagccttatcatcacaatcc

SEQ ID NO: 28083 - DNA, 24 bp, Homo sapiens
ggacatcgtggcctccaaggggag

SEQ ID NO: 28084 - DNA, 24 bp, Homo sapiens
aggacatcgtggcctccaagggga

SEQ ID NO: 28085 - DNA, 24 bp, Homo sapiens
gaggacatcgtggcctccaagggg

SEQ ID NO: 28086 - DNA, 23 bp, Homo sapiens
cccaaactcctgtgccgcctgac

SEQ ID NO: 28087 - DNA, 24 bp, Homo sapiens
ctaacaaccacctggagacgctgc

SEQ ID NO: 28088 - DNA, 23 bp, Homo sapiens
gggatgttactgccttgtgccag

SEQ ID NO: 28089 - DNA, 24 bp, Homo sapiens
gtgccaactgggaagaagatgagc

SEQ ID NO: 28090 - DNA, 23 bp, Homo sapiens
gctgaggatgctggtctgggttc

SEQ ID NO: 28091 - DNA, 25 bp, Homo sapiens
gcaacccaaagaacagaaatccagc

SEQ ID NO: 28092 - DNA, 24 bp, Homo sapiens
actgaaaagaggtacaaatctatt

SEQ ID NO: 28093 - DNA, 24 bp, Homo sapiens
cactgaaaagaggtacaaatctat

SEQ ID NO: 28094 - DNA, 24 bp, Homo sapiens
tcactgaaaagaggtacaaatcta

SEQ ID NO: 28095 - DNA, 24 bp, Homo sapiens
gggtgctgactgaggatgagatgg

SEQ ID NO: 28096 - DNA, 24 bp, Homo sapiens
ggtggagccaaggaaacaggatgc

SEQ ID NO: 28097 - DNA, 24 bp, Homo sapiens
gactgtgggctggtgtgtggaact

SEQ ID NO: 28098 - DNA, 24 bp, Homo sapiens
gactgtgggctggtgtgtggaact

SEQ ID NO: 28099 - DNA, 24 bp, Homo sapiens
cctcagaatgaacggagaccagaa

SEQ ID NO: 28100 - DNA, 24 bp, Homo sapiens
ggtgccaagcgtggacagaggaac

SEQ ID NO: 28101 - DNA, 24 bp, Homo sapiens
ttcaccaaatggatactatggaag

SEQ ID NO: 28102 - DNA, 24 bp, Homo sapiens
attcaccaaatggatactatggaa

SEQ ID NO: 28103 - DNA, 24 bp, Homo sapiens
aattcaccaaatggatactatgga

SEQ ID NO: 28104 - DNA, 24 bp, Homo sapiens
agtgaaatcaggcttgaagagaat

SEQ ID NO: 28105 - DNA, 24 bp, Homo sapiens
cagtgaaatcaggcttgaagagaa

SEQ ID NO: 28106 - DNA, 24 bp, Homo sapiens
gcagtgaaatcaggcttgaagaga

SEQ ID NO: 28107 - DNA, 24 bp, Homo sapiens
ttaatgctatgggagatgttaatc

SEQ ID NO: 28108 - DNA, 24 bp, Homo sapiens
attaatgctatgggagatgttaat

SEQ ID NO: 28109 - DNA, 24 bp, Homo sapiens
cattaatgctatgggagatgttaa

SEQ ID NO: 28110 - DNA, 25 bp, Homo sapiens
tccaccaagagcacatctacttacg

SEQ ID NO: 28111 - DNA, 24 bp, Homo sapiens
gcctgttgagtctgatgtggaagc

SEQ ID NO: 28112 - DNA, 25 bp, Homo sapiens
aagcacagcacatggtactgatgat

SEQ ID NO: 28113 - DNA, 25 bp, Homo sapiens
tcagccacaacattcccttaaacca

SEQ ID NO: 28114 - DNA, 25 bp, Homo sapiens
tctgtgaagtctgagagatgtgagg

SEQ ID NO: 28115 - DNA, 25 bp, Homo sapiens
tgctatggagaaagtttgaaaggtc

SEQ ID NO: 28116 - DNA, 23 bp, Homo sapiens
ggattacaggcatgaaccatcgc

SEQ ID NO: 28117 - DNA, 25 bp, Homo sapiens
gttagccaggatggtctcgatctcc

SEQ ID NO: 28118 - DNA, 25 bp, Homo sapiens
tgacttcttgactcctctctctccg

SEQ ID NO: 28119 - DNA, 24 bp, Homo sapiens
ctgtaggacattgtatcaggctgc

SEQ ID NO: 28120 - DNA, 23 bp, Homo sapiens
ggattacaggcatgaaccatcgc

SEQ ID NO: 28121 - DNA, 23 bp, Homo sapiens
atctcctgacctcgtgatctgcc

SEQ ID NO: 28122 - DNA, 24 bp, Homo sapiens
ttcctggggagccctcctctgact

SEQ ID NO: 28123 - DNA, 24 bp, Homo sapiens
cttcctggggagccctcctctgac

SEQ ID NO: 28124 - DNA, 24 bp, Homo sapiens
acttcctggggagccctcctctga

SEQ ID NO: 28125 - DNA, 25 bp, Homo sapiens
tgccatacaacagcttcatcacgga

SEQ ID NO: 28126 - DNA, 24 bp, Homo sapiens
ccgatgaccgttatcacgccatct

SEQ ID NO: 28127 - DNA, 23 bp, Homo sapiens
gatgctgctggctggcgtgggct

SEQ ID NO: 28128 - DNA, 24 bp, Homo sapiens
catcttcttcctggtgtcggtggc

SEQ ID NO: 28129 - DNA, 24 bp, Homo sapiens
gccgcttcgtgctcttctatacca

SEQ ID NO: 28130 - DNA, 23 bp, Homo sapiens
caaaggacagcccagcccacgag

SEQ ID NO: 28131 - DNA, 23 bp, Homo sapiens
caaaggacagcccagcccacgag

SEQ ID NO: 28132 - DNA, 23 bp, Homo sapiens
gctctccatcgccgtgacctact

SEQ ID NO: 28133 - DNA, 25 bp, Homo sapiens
gtgttcaacctgtcagacttcgtgg

SEQ ID NO: 28134 - DNA, 24 bp, Homo sapiens
ggaaatcagagcccaagatcaaga

SEQ ID NO: 28135 - DNA, 24 bp, Homo sapiens
aggaaatcagagcccaagatcaag

SEQ ID NO: 28136 - DNA, 24 bp, Homo sapiens
aaggaaatcagagcccaagatcaa

SEQ ID NO: 28137 - DNA, 24 bp, Homo sapiens
ggaataagatgttataaatctgga

SEQ ID NO: 28138 - DNA, 24 bp, Homo sapiens
gggaataagatgttataaatctgg

SEQ ID NO: 28139 - DNA, 24 bp, Homo sapiens
ggggaataagatgttataaatctg

SEQ ID NO: 28140 - DNA, 24 bp, Homo sapiens
tttctttacagtgtctctgcaaat

SEQ ID NO: 28141 - DNA, 24 bp, Homo sapiens
gtttctttacagtgtctctgcaaa

SEQ ID NO: 28142 - DNA, 24 bp, Homo sapiens
tgtttctttacagtgtctctgcaa

SEQ ID NO: 28143 - DNA, 24 bp, Homo sapiens
agaaccaggagctggagccagacc

SEQ ID NO: 28144 - DNA, 24 bp, Homo sapiens
gagaaccaggagctggagccagac

SEQ ID NO: 28145 - DNA, 24 bp, Homo sapiens
tgagaaccaggagctggagccaga

SEQ ID NO: 28146 - DNA, 23 bp, Homo sapiens
ggtgaggagctgccaggtgtgtg

SEQ ID NO: 28147 - DNA, 23 bp, Homo sapiens
tacaacgggcttcctgagaacca

SEQ ID NO: 28148 - DNA, 23 bp, Homo sapiens
agccagacctgagctgtgacaca

SEQ ID NO: 28149 - DNA, 24 bp, Homo sapiens
tctaacatcaggtacaaataagaa

SEQ ID NO: 28150 - DNA, 24 bp, Homo sapiens
gtctaacatcaggtacaaataaga

SEQ ID NO: 28151 - DNA, 24 bp, Homo sapiens
agtctaacatcaggtacaaataag

SEQ ID NO: 28152 - DNA, 24 bp, Homo sapiens
tttagctaaagcaaaggtatattt

SEQ ID NO: 28153 - DNA, 24 bp, Homo sapiens
ctttagctaaagcaaaggtatatt

SEQ ID NO: 28154 - DNA, 24 bp, Homo sapiens
gctttagctaaagcaaaggtatat

SEQ ID NO: 28155 - DNA, 24 bp, Homo sapiens
tgggagaattactgggcaagggaa

SEQ ID NO: 28156 - DNA, 24 bp, Homo sapiens
tctgagaaggaagaaggatgaact

SEQ ID NO: 28157 - DNA, 24 bp, Homo sapiens
tagacgctgctgctggtatgttgt

SEQ ID NO: 28158 - DNA, 24 bp, Homo sapiens
accgttagactgccacgagaatgc

SEQ ID NO: 28159 - DNA, 24 bp, Homo sapiens
tccattcgattttcagctataaaa

SEQ ID NO: 28160 - DNA, 25 bp, Homo sapiens
aggctggaggagaaccattacaaca

SEQ ID NO: 28161 - DNA, 23 bp, Homo sapiens
catgcagagaagaattggtttgt

SEQ ID NO: 28162 - DNA, 25 bp, Homo sapiens
caagaagaatgggagctgcaaacgc

SEQ ID NO: 28163 - DNA, 24 bp, Homo sapiens
gttcatttaaaggctactattcat

SEQ ID NO: 28164 - DNA, 24 bp, Homo sapiens
agttcatttaaaggctactattca

SEQ ID NO: 28165 - DNA, 24 bp, Homo sapiens
aagttcatttaaaggctactattc

SEQ ID NO: 28166 - DNA, 24 bp, Homo sapiens
attgcaaacagaagtcaaatagca

SEQ ID NO: 28167 - DNA, 24 bp, Homo sapiens
cattgcaaacagaagtcaaatagc

SEQ ID NO: 28168 - DNA, 24 bp, Homo sapiens
tcattgcaaacagaagtcaaatag

SEQ ID NO: 28169 - DNA, 24 bp, Homo sapiens
ctacagttcgccgcatttcacagc

SEQ ID NO: 28170 - DNA, 24 bp, Homo sapiens
ccgagttaagaagaccaaggcagc

SEQ ID NO: 28171 - DNA, 24 bp, Homo sapiens
ccagccaccaccacaacctgtctc

SEQ ID NO: 28172 - DNA, 23 bp, Homo sapiens
gctggagctgatcctggagacca

SEQ ID NO: 28173 - DNA, 24 bp, Homo sapiens
tgtggagtctgggctgtatcctgg

SEQ ID NO: 28174 - DNA, 25 bp, Homo sapiens
ctctcttcgcaccgatacacccttg

SEQ ID NO: 28175 - DNA, 23 bp, Homo sapiens
cttgctcctgcttgccttcctcc

SEQ ID NO: 28176 - DNA, 23 bp, Homo sapiens
ccgctgaagcaagtacaccacaa

SEQ ID NO: 28177 - DNA, 25 bp, Homo sapiens
atgttacgacaagattccatccaat

SEQ ID NO: 28178 - DNA, 25 bp, Homo sapiens
gcagaacaaggaatggcatgaagaa

SEQ ID NO: 28179 - DNA, 24 bp, Homo sapiens
gcacagaggcatggatgttgcttc

SEQ ID NO: 28180 - DNA, 23 bp, Homo sapiens
ccaaggcaggcggattgcttgag

SEQ ID NO: 28181 - DNA, 23 bp, Homo sapiens
gagctgcctgccgaccccaaatg

SEQ ID NO: 28182 - DNA, 23 bp, Homo sapiens
gcgtccatgagctccaacacacc

SEQ ID NO: 28183 - DNA, 23 bp, Homo sapiens
gcgcatcgcaaggctgtcctcag

SEQ ID NO: 28184 - DNA, 25 bp, Homo sapiens
ggagatgatgaggatgacaccgatg

SEQ ID NO: 28185 - DNA, 23 bp, Homo sapiens
gcctctatgcttgtactgccagt

SEQ ID NO: 28186 - DNA, 23 bp, Homo sapiens
cctgttgaaagatgccgccgtga

SEQ ID NO: 28187 - DNA, 23 bp, Homo sapiens
aagcaggagcatcgcattggagg

SEQ ID NO: 28188 - DNA, 24 bp, Homo sapiens
cagcactggagcctcattatggaa

SEQ ID NO: 28189 - DNA, 23 bp, Homo sapiens
cacctggatgttgtggagcgatc

SEQ ID NO: 28190 - DNA, 25 bp, Homo sapiens
tcctatgacattaaccgtgttcctg

SEQ ID NO: 28191 - DNA, 24 bp, Homo sapiens
aacctccgagaatacctccgagcc

SEQ ID NO: 28192 - DNA, 25 bp, Homo sapiens
tggtgtcagagatggagatgatgaa

SEQ ID NO: 28193 - DNA, 24 bp, Homo sapiens
gcaggctcgaggaaggcagttggt

SEQ ID NO: 28194 - DNA, 24 bp, Homo sapiens
cgcaggctcgaggaaggcagttgg

SEQ ID NO: 28195 - DNA, 24 bp, Homo sapiens
acgcaggctcgaggaaggcagttg

SEQ ID NO: 28196 - DNA, 25 bp, Homo sapiens
cagcaacaggtcaagatcaagcagc

SEQ ID NO: 28197 - DNA, 25 bp, Homo sapiens
ggagaatgaagtccagttccttgat

SEQ ID NO: 28198 - DNA, 25 bp, Homo sapiens
ttggaagcaagaggcagtatgcaga

SEQ ID NO: 28199 - DNA, 24 bp, Homo sapiens
ataaaagccagagctcaaatgata

SEQ ID NO: 28200 - DNA, 24 bp, Homo sapiens
aataaaagccagagctcaaatgat

SEQ ID NO: 28201 - DNA, 24 bp, Homo sapiens
taataaaagccagagctcaaatga

SEQ ID NO: 28202 - DNA, 24 bp, Homo sapiens
agtccgcagccgccgccgccaccg

SEQ ID NO: 28203 - DNA, 24 bp, Homo sapiens
ctcggcctcggtgcaggcagcggc

SEQ ID NO: 28204 - DNA, 25 bp, Homo sapiens
tgtatgtatcaacttgcctggaagc

SEQ ID NO: 28205 - DNA, 23 bp, Homo sapiens
agtcatacctgtgctcctgctgg

SEQ ID NO: 28206 - DNA, 23 bp, Homo sapiens
ctgtgcctgcctgcctggttatg

SEQ ID NO: 28207 - DNA, 24 bp, Homo sapiens
caagcagtcctcctacctcagcct

SEQ ID NO: 28208 - DNA, 23 bp, Homo sapiens
gtctcactctgtcacgcaggctg

SEQ ID NO: 28209 - DNA, 25 bp, Homo sapiens
tcctccagtgtcctgtcagtatgaa

SEQ ID NO: 28210 - DNA, 24 bp, Homo sapiens
tgcaaagaacaaaactgacactag

SEQ ID NO: 28211 - DNA, 24 bp, Homo sapiens
atgcaaagaacaaaactgacacta

SEQ ID NO: 28212 - DNA, 24 bp, Homo sapiens
aatgcaaagaacaaaactgacact

SEQ ID NO: 28213 - DNA, 23 bp, Homo sapiens
cgcagtcaggctgggctctgtag

SEQ ID NO: 28214 - DNA, 23 bp, Homo sapiens
caggagaagtaccggctcgtggt

SEQ ID NO: 28215 - DNA, 23 bp, Homo sapiens
gccctccagacgcctcccggtac

SEQ ID NO: 28216 - DNA, 24 bp, Homo sapiens
gataatgtcaggttatgggaagct

SEQ ID NO: 28217 - DNA, 24 bp, Homo sapiens
ggataatgtcaggttatgggaagc

SEQ ID NO: 28218 - DNA, 24 bp, Homo sapiens
aggataatgtcaggttatgggaag

SEQ ID NO: 28219 - DNA, 24 bp, Homo sapiens
ttcttttccagtattaattttaaa

SEQ ID NO: 28220 - DNA, 24 bp, Homo sapiens
gttcttttccagtattaattttaa

SEQ ID NO: 28221 - DNA, 24 bp, Homo sapiens
tgttcttttccagtattaatttta

SEQ ID NO: 28222 - DNA, 24 bp, Homo sapiens
attggcaaaagggaactgaattca

SEQ ID NO: 28223 - DNA, 24 bp, Homo sapiens
tattggcaaaagggaactgaattc

SEQ ID NO: 28224 - DNA, 24 bp, Homo sapiens
atattggcaaaagggaactgaatt

SEQ ID NO: 28225 - DNA, 24 bp, Homo sapiens
agacataggagatgattcaatgaa

SEQ ID NO: 28226 - DNA, 24 bp, Homo sapiens
aagacataggagatgattcaatga

SEQ ID NO: 28227 - DNA, 24 bp, Homo sapiens
gaagacataggagatgattcaatg

SEQ ID NO: 28228 - DNA, 23 bp, Homo sapiens
cataaggcttgccagacatcgtc

SEQ ID NO: 28229 - DNA, 25 bp, Homo sapiens
ttgaacaggaatgtatgagttgagc

SEQ ID NO: 28230 - DNA, 23 bp, Homo sapiens
gagatcgcgccactgcactccag

SEQ ID NO: 28231 - DNA, 25 bp, Homo sapiens
tctccgctcccaccttctttcttca

SEQ ID NO: 28232 - DNA, 25 bp, Homo sapiens
gtcctcggatcacagtctcttctca

SEQ ID NO: 28233 - DNA, 23 bp, Homo sapiens
ccgccgccgcctctccttgctgc

SEQ ID NO: 28234 - DNA, 23 bp, Homo sapiens
ctccctaccctctctgtccgcca

SEQ ID NO: 28235 - DNA, 23 bp, Homo sapiens
aagacggctcgcaagtttcgctt

SEQ ID NO: 28236 - DNA, 23 bp, Homo sapiens
gtgcaacggcgtgatctcagctc

SEQ ID NO: 28237 - DNA, 24 bp, Homo sapiens
ttattttccaggataaggaatcaa

SEQ ID NO: 28238 - DNA, 24 bp, Homo sapiens
tttattttccaggataaggaatca

SEQ ID NO: 28239 - DNA, 24 bp, Homo sapiens
ttttattttccaggataaggaatc

SEQ ID NO: 28240 - DNA, 23 bp, Homo sapiens
gcagatggcagcagtgacaatgg

SEQ ID NO: 28241 - DNA, 24 bp, Homo sapiens
actccgtcaccatgaagcacaagg

SEQ ID NO: 28242 - DNA, 24 bp, Homo sapiens
gccttggagcagatgaactcggtg

SEQ ID NO: 28243 - DNA, 24 bp, Homo sapiens
tttttaaaaaggaaaatgaacgat

SEQ ID NO: 28244 - DNA, 24 bp, Homo sapiens
gtttttaaaaaggaaaatgaacga

SEQ ID NO: 28245 - DNA, 24 bp, Homo sapiens
tgtttttaaaaaggaaaatgaacg

SEQ ID NO: 28246 - DNA, 24 bp, Homo sapiens
ttgctctgtagggtcaaggaagat

SEQ ID NO: 28247 - DNA, 24 bp, Homo sapiens
tttgctctgtagggtcaaggaaga

SEQ ID NO: 28248 - DNA, 24 bp, Homo sapiens
atttgctctgtagggtcaaggaag

SEQ ID NO: 28249 - DNA, 24 bp, Homo sapiens
agaaaatgaagggtcaaggaagat

SEQ ID NO: 28250 - DNA, 24 bp, Homo sapiens
cagaaaatgaagggtcaaggaaga

SEQ ID NO: 28251 - DNA, 24 bp, Homo sapiens
tcagaaaatgaagggtcaaggaag

SEQ ID NO: 28252 - DNA, 24 bp, Homo sapiens
catttattcaggtgcttttcagtg

SEQ ID NO: 28253 - DNA, 24 bp, Homo sapiens
tcatttattcaggtgcttttcagt

SEQ ID NO: 28254 - DNA, 24 bp, Homo sapiens
ttcatttattcaggtgcttttcag

SEQ ID NO: 28255 - DNA, 24 bp, Homo sapiens
tgtctgataaggaaaataactctg

SEQ ID NO: 28256 - DNA, 24 bp, Homo sapiens
gtgtctgataaggaaaataactct

SEQ ID NO: 28257 - DNA, 24 bp, Homo sapiens
tgtgtctgataaggaaaataactc

SEQ ID NO: 28258 - DNA, 25 bp, Homo sapiens
catctcagtcacagtccagagcagt

SEQ ID NO: 28259 - DNA, 23 bp, Homo sapiens
gtccctccacgcaccacttcaaa

SEQ ID NO: 28260 - DNA, 23 bp, Homo sapiens
cctagtggcgtataagaagaccc

SEQ ID NO: 28261 - DNA, 24 bp, Homo sapiens
tccagaaagtggaagtctcaaatc

SEQ ID NO: 28262 - DNA, 24 bp, Homo sapiens
ttccagaaagtggaagtctcaaat

SEQ ID NO: 28263 - DNA, 24 bp, Homo sapiens
gttccagaaagtggaagtctcaaa

SEQ ID NO: 28264 - DNA, 24 bp, Homo sapiens
tgctggaactgctgaaaaaaggaa

SEQ ID NO: 28265 - DNA, 24 bp, Homo sapiens
ctgctggaactgctgaaaaaagga

SEQ ID NO: 28266 - DNA, 24 bp, Homo sapiens
tctgctggaactgctgaaaaaagg

SEQ ID NO: 28267 - DNA, 25 bp, Homo sapiens
actgaagtgctgataatggcttgga

SEQ ID NO: 28268 - DNA, 23 bp, Homo sapiens
gcaccagacagtgttcaccgagg

SEQ ID NO: 28269 - DNA, 23 bp, Homo sapiens
acaggacaggcaccagcaaacac

SEQ ID NO: 28270 - DNA, 25 bp, Homo sapiens
aacttgcactcgttggagaactcct

SEQ ID NO: 28271 - DNA, 25 bp, Homo sapiens
aaggtaaacactaccctcccagtgg

SEQ ID NO: 28272 - DNA, 23 bp, Homo sapiens
aatgagtttcgctgatataatgt

SEQ ID NO: 28273 - DNA, 24 bp, Homo sapiens
tcattttgcagatgccttcctgga

SEQ ID NO: 28274 - DNA, 24 bp, Homo sapiens
atcattttgcagatgccttcctgg

SEQ ID NO: 28275 - DNA, 24 bp, Homo sapiens
aatcattttgcagatgccttcctg

SEQ ID NO: 28276 - DNA, 24 bp, Homo sapiens
tcagaaatcaagtatgtatgaaat

SEQ ID NO: 28277 - DNA, 24 bp, Homo sapiens
atcagaaatcaagtatgtatgaaa

SEQ ID NO: 28278 - DNA, 24 bp, Homo sapiens
aatcagaaatcaagtatgtatgaa

SEQ ID NO: 28279 - DNA, 24 bp, Homo sapiens
atacatttcaggcttgaaaaagat

SEQ ID NO: 28280 - DNA, 24 bp, Homo sapiens
tatacatttcaggcttgaaaaaga

SEQ ID NO: 28281 - DNA, 24 bp, Homo sapiens
atatacatttcaggcttgaaaaag

SEQ ID NO: 28282 - DNA, 24 bp, Homo sapiens
ttgtttcaaagtctgaagatgaaa

SEQ ID NO: 28283 - DNA, 24 bp, Homo sapiens
tttgtttcaaagtctgaagatgaa

SEQ ID NO: 28284 - DNA, 24 bp, Homo sapiens
ttttgtttcaaagtctgaagatga

SEQ ID NO: 28285 - DNA, 24 bp, Homo sapiens
tgtttcaacagtggttttagtgaa

SEQ ID NO: 28286 - DNA, 24 bp, Homo sapiens
ttgtttcaacagtggttttagtga

SEQ ID NO: 28287 - DNA, 24 bp, Homo sapiens
tttgtttcaacagtggttttagtg

SEQ ID NO: 28288 - DNA, 24 bp, Homo sapiens
ggaggaagaggaggaggaggagga

SEQ ID NO: 28289 - DNA, 25 bp, Homo sapiens
aatgctccagttagtgcctgtgacc

SEQ ID NO: 28290 - DNA, 23 bp, Homo sapiens
ccagagcacaggcggcagtctac

SEQ ID NO: 28291 - DNA, 24 bp, Homo sapiens
tttgataacagaatactagttgat

SEQ ID NO: 28292 - DNA, 24 bp, Homo sapiens
gtttgataacagaatactagttga

SEQ ID NO: 28293 - DNA, 24 bp, Homo sapiens
tgtttgataacagaatactagttg

SEQ ID NO: 28294 - DNA, 24 bp, Homo sapiens
aaattaccagggtatgttatttta

SEQ ID NO: 28295 - DNA, 24 bp, Homo sapiens
aaaattaccagggtatgttatttt

SEQ ID NO: 28296 - DNA, 24 bp, Homo sapiens
caaaattaccagggtatgttattt

SEQ ID NO: 28297 - DNA, 23 bp, Homo sapiens
cagaggaggagcaggaggacgac

SEQ ID NO: 28298 - DNA, 25 bp, Homo sapiens
ttctactgataggacatctgttcca

SEQ ID NO: 28299 - DNA, 25 bp, Homo sapiens
aaatggataccctttcaactggaga

SEQ ID NO: 28300 - DNA, 24 bp, Homo sapiens
aagacacagataagctgctgggaa

SEQ ID NO: 28301 - DNA, 24 bp, Homo sapiens
caagacacagataagctgctggga

SEQ ID NO: 28302 - DNA, 24 bp, Homo sapiens
gcaagacacagataagctgctggg

SEQ ID NO: 28303 - DNA, 25 bp, Homo sapiens
ctacagatacaaagaagcgagtggc

SEQ ID NO: 28304 - DNA, 25 bp, Homo sapiens
gcctcattgatgctactcacagaga

SEQ ID NO: 28305 - DNA, 23 bp, Homo sapiens
ctgcctgatgatgagaagttcca

SEQ ID NO: 28306 - DNA, 24 bp, Homo sapiens
ttcaaaaccaggaatcatatgaag

SEQ ID NO: 28307 - DNA, 24 bp, Homo sapiens
attcaaaaccaggaatcatatgaa

SEQ ID NO: 28308 - DNA, 24 bp, Homo sapiens
tattcaaaaccaggaatcatatga

SEQ ID NO: 28309 - DNA, 24 bp, Homo sapiens
ttcaaaaccaggtatatgtaaaaa

SEQ ID NO: 28310 - DNA, 24 bp, Homo sapiens
attcaaaaccaggtatatgtaaaa

SEQ ID NO: 28311 - DNA, 24 bp, Homo sapiens
tattcaaaaccaggtatatgtaaa

SEQ ID NO: 28312 - DNA, 25 bp, Homo sapiens
tgaagaaggcagaggaggcaatatg

SEQ ID NO: 28313 - DNA, 25 bp, Homo sapiens
ctagtgaagcaggcgttaaggaatt

SEQ ID NO: 28314 - DNA, 25 bp, Homo sapiens
ttgccagtagggagaagggaaagtt

SEQ ID NO: 28315 - DNA, 24 bp, Homo sapiens
tctttttccagttcacctttcttg

SEQ ID NO: 28316 - DNA, 24 bp, Homo sapiens
gtctttttccagttcacctttctt

SEQ ID NO: 28317 - DNA, 24 bp, Homo sapiens
tgtctttttccagttcacctttct

SEQ ID NO: 28318 - DNA, 24 bp, Homo sapiens
cggagcaggaggtgaagaaagcag

SEQ ID NO: 28319 - DNA, 23 bp, Homo sapiens
agaccaagaggctctcctgctgc

SEQ ID NO: 28320 - DNA, 23 bp, Homo sapiens
gtgcctatgccgctgtgctctat

SEQ ID NO: 28321 - DNA, 23 bp, Homo sapiens
atggttctgcaggctgtacaaga

SEQ ID NO: 28322 - DNA, 23 bp, Homo sapiens
aatttgtaaagaagagagttctt

SEQ ID NO: 28323 - DNA, 24 bp, Homo sapiens
tgataaaacaggtagggtaatagc

SEQ ID NO: 28324 - DNA, 24 bp, Homo sapiens
ctgataaaacaggtagggtaatag

SEQ ID NO: 28325 - DNA, 24 bp, Homo sapiens
tctgataaaacaggtagggtaata

SEQ ID NO: 28326 - DNA, 24 bp, Homo sapiens
ttattttgcagtaaattctatcaa

SEQ ID NO: 28327 - DNA, 24 bp, Homo sapiens
tttattttgcagtaaattctatca

SEQ ID NO: 28328 - DNA, 24 bp, Homo sapiens
ttttattttgcagtaaattctatc

SEQ ID NO: 28329 - DNA, 24 bp, Homo sapiens
aaacttagaatatggagtgtcact

SEQ ID NO: 28330 - DNA, 24 bp, Homo sapiens
aaaacttagaatatggagtgtcac

SEQ ID NO: 28331 - DNA, 24 bp, Homo sapiens
gaaaacttagaatatggagtgtca

SEQ ID NO: 28332 - DNA, 24 bp, Homo sapiens
atattttataggtgtttcaaatga

SEQ ID NO: 28333 - DNA, 24 bp, Homo sapiens
aatattttataggtgtttcaaatg

SEQ ID NO: 28334 - DNA, 24 bp, Homo sapiens
caatattttataggtgtttcaaat

SEQ ID NO: 28335 - DNA, 24 bp, Homo sapiens
actgctcgacaggagcatcctggg

SEQ ID NO: 28336 - DNA, 24 bp, Homo sapiens
gactgctcgacaggagcatcctgg

SEQ ID NO: 28337 - DNA, 24 bp, Homo sapiens
ggactgctcgacaggagcatcctg

SEQ ID NO: 28338 - DNA, 24 bp, Homo sapiens
aaggaacttagaatttggaaatta

SEQ ID NO: 28339 - DNA, 24 bp, Homo sapiens
caaggaacttagaatttggaaatt

SEQ ID NO: 28340 - DNA, 24 bp, Homo sapiens
ccaaggaacttagaatttggaaat

SEQ ID NO: 28341 - DNA, 25 bp, Homo sapiens
ccgtgttcagcaacagttctaaccg

SEQ ID NO: 28342 - DNA, 24 bp, Homo sapiens
cagtgaccggccccttcaatcaaa

SEQ ID NO: 28343 - DNA, 24 bp, Homo sapiens
agagagaagcccagaccagagcag

SEQ ID NO: 28344 - DNA, 23 bp, Homo sapiens
cagagcctgaggatgtcgccgtc

SEQ ID NO: 28345 - DNA, 25 bp, Homo sapiens
gccactgaacctaaggaggattgcg

SEQ ID NO: 28346 - DNA, 23 bp, Homo sapiens
ccctccaagcatcggtcaccctg

SEQ ID NO: 28347 - DNA, 24 bp, Homo sapiens
tcctcacatcctaccgctccactg

SEQ ID NO: 28348 - DNA, 23 bp, Homo sapiens
aactcctgccactcctcaagcct

SEQ ID NO: 28349 - DNA, 24 bp, Homo sapiens
tgctaacaaagacactattttaga

SEQ ID NO: 28350 - DNA, 24 bp, Homo sapiens
ttgctaacaaagacactattttag

SEQ ID NO: 28351 - DNA, 24 bp, Homo sapiens
cttgctaacaaagacactatttta

SEQ ID NO: 28352 - DNA, 24 bp, Homo sapiens
caacttccgtggttttgattacta

SEQ ID NO: 28353 - DNA, 24 bp, Homo sapiens
ccaacttccgtggttttgattact

SEQ ID NO: 28354 - DNA, 24 bp, Homo sapiens
cccaacttccgtggttttgattac

SEQ ID NO: 28355 - DNA, 24 bp, Homo sapiens
accaagagaaagcgggacagagga

SEQ ID NO: 28356 - DNA, 23 bp, Homo sapiens
agcaagcggaaacggcgacctcg

SEQ ID NO: 28357 - DNA, 23 bp, Homo sapiens
catccgcatcagtgacgacagca

SEQ ID NO: 28358 - DNA, 23 bp, Homo sapiens
gacagcctccgccgcaagttcca

SEQ ID NO: 28359 - DNA, 25 bp, Homo sapiens
tgacggcttctacctctcctacaag

SEQ ID NO: 28360 - DNA, 24 bp, Homo sapiens
cttctacaagatcagcgtggaccg

SEQ ID NO: 28361 - DNA, 23 bp, Homo sapiens
ctacggtcgctcccgcctctcga

SEQ ID NO: 28362 - DNA, 23 bp, Homo sapiens
agacgcggcggtggcggcggctc

SEQ ID NO: 28363 - DNA, 23 bp, Homo sapiens
ggtggccgcagcggcgcacccac

SEQ ID NO: 28364 - DNA, 24 bp, Homo sapiens
atttcttacagttttatgtgctga

SEQ ID NO: 28365 - DNA, 24 bp, Homo sapiens
tatttcttacagttttatgtgctg

SEQ ID NO: 28366 - DNA, 24 bp, Homo sapiens
ttatttcttacagttttatgtgct

SEQ ID NO: 28367 - DNA, 25 bp, Homo sapiens
gatgctgtcactcggcttcttgagg

SEQ ID NO: 28368 - DNA, 23 bp, Homo sapiens
gccagtcgttgttgaagaagaac

SEQ ID NO: 28369 - DNA, 24 bp, Homo sapiens
tggaggagcaggtggaacacatca

SEQ ID NO: 28370 - DNA, 24 bp, Homo sapiens
gactttaccagaactggaaagaga

SEQ ID NO: 28371 - DNA, 24 bp, Homo sapiens
tgactttaccagaactggaaagag

SEQ ID NO: 28372 - DNA, 24 bp, Homo sapiens
ctgactttaccagaactggaaaga

SEQ ID NO: 28373 - DNA, 24 bp, Homo sapiens
tcagttatcagctactggtcagaa

SEQ ID NO: 28374 - DNA, 24 bp, Homo sapiens
atcagttatcagctactggtcaga

SEQ ID NO: 28375 - DNA, 24 bp, Homo sapiens
tatcagttatcagctactggtcag

SEQ ID NO: 28376 - DNA, 23 bp, Homo sapiens
cagtaccgcctccttcccagccg

SEQ ID NO: 28377 - DNA, 23 bp, Homo sapiens
cgtgtgcccagcctcttcccgcc

SEQ ID NO: 28378 - DNA, 23 bp, Homo sapiens
cggcgacggcgacgacgacgact

SEQ ID NO: 28379 - DNA, 24 bp, Homo sapiens
tttttctctagagatgagtgaatt

SEQ ID NO: 28380 - DNA, 24 bp, Homo sapiens
ctttttctctagagatgagtgaat

SEQ ID NO: 28381 - DNA, 24 bp, Homo sapiens
tctttttctctagagatgagtgaa

SEQ ID NO: 28382 - DNA, 23 bp, Homo sapiens
ggctggctgctgctatgacaaca

SEQ ID NO: 28383 - DNA, 25 bp, Homo sapiens
tgcttcagagatggctacttcgtcc

SEQ ID NO: 28384 - DNA, 25 bp, Homo sapiens
cttctacttccctctcacccactgt

SEQ ID NO: 28385 - DNA, 24 bp, Homo sapiens
gtgttgacaaagtaagtaaacgtt

SEQ ID NO: 28386 - DNA, 24 bp, Homo sapiens
ggtgttgacaaagtaagtaaacgt

SEQ ID NO: 28387 - DNA, 24 bp, Homo sapiens
gggtgttgacaaagtaagtaaacg

SEQ ID NO: 28388 - DNA, 24 bp, Homo sapiens
aaaatgatatggtggaaatggata

SEQ ID NO: 28389 - DNA, 24 bp, Homo sapiens
aaaaatgatatggtggaaatggat

SEQ ID NO: 28390 - DNA, 24 bp, Homo sapiens
taaaaatgatatggtggaaatgga

SEQ ID NO: 28391 - DNA, 24 bp, Homo sapiens
tgtattttcagaggtaaattttga

SEQ ID NO: 28392 - DNA, 24 bp, Homo sapiens
ttgtattttcagaggtaaattttg

SEQ ID NO: 28393 - DNA, 24 bp, Homo sapiens
attgtattttcagaggtaaatttt

SEQ ID NO: 28394 - DNA, 23 bp, Homo sapiens
cgtcgctgctgctgctgctgctg

SEQ ID NO: 28395 - DNA, 23 bp, Homo sapiens
gagagcccagtggttagcgatgc

SEQ ID NO: 28396 - DNA, 23 bp, Homo sapiens
gtggagacagcggtggcggagtg

SEQ ID NO: 28397 - DNA, 24 bp, Homo sapiens
acagagatgatatggtaaaagatg

SEQ ID NO: 28398 - DNA, 24 bp, Homo sapiens
tacagagatgatatggtaaaagat

SEQ ID NO: 28399 - DNA, 24 bp, Homo sapiens
atacagagatgatatggtaaaaga

SEQ ID NO: 28400 - DNA, 24 bp, Homo sapiens
gatgtttattcgtaagtatgttaa

SEQ ID NO: 28401 - DNA, 24 bp, Homo sapiens
tgatgtttattcgtaagtatgtta

SEQ ID NO: 28402 - DNA, 24 bp, Homo sapiens
atgatgtttattcgtaagtatgtt

SEQ ID NO: 28403 - DNA, 23 bp, Homo sapiens
accttccgccatgattgtgaggc

SEQ ID NO: 28404 - DNA, 25 bp, Homo sapiens
gtacagagtatttcatcacccaggt

SEQ ID NO: 28405 - DNA, 24 bp, Homo sapiens
ggaactggggacacatgcaggttt

SEQ ID NO: 28406 - DNA, 23 bp, Homo sapiens
gcttcaccttcaggctggattcc

SEQ ID NO: 28407 - DNA, 23 bp, Homo sapiens
aggaggagtggcggcaactggac

SEQ ID NO: 28408 - DNA, 25 bp, Homo sapiens
ggatgtgatgttggagaactacagc

SEQ ID NO: 28409 - DNA, 24 bp, Homo sapiens
agagccagacccctctcaccctct

SEQ ID NO: 28410 - DNA, 24 bp, Homo sapiens
cagagccagacccctctcaccctc

SEQ ID NO: 28411 - DNA, 24 bp, Homo sapiens
gcagagccagacccctctcaccct

SEQ ID NO: 28412 - DNA, 24 bp, Homo sapiens
aggaggctcaggactcagattcag

SEQ ID NO: 28413 - DNA, 24 bp, Homo sapiens
caggaggctcaggactcagattca

SEQ ID NO: 28414 - DNA, 24 bp, Homo sapiens
gcaggaggctcaggactcagattc

SEQ ID NO: 28415 - DNA, 24 bp, Homo sapiens
gacacccagagatcgaccttgcca

SEQ ID NO: 28416 - DNA, 24 bp, Homo sapiens
cgacacccagagatcgaccttgcc

SEQ ID NO: 28417 - DNA, 24 bp, Homo sapiens
tcgacacccagagatcgaccttgc

SEQ ID NO: 28418 - DNA, 24 bp, Homo sapiens
ggttattagaggtcatttatagca

SEQ ID NO: 28419 - DNA, 24 bp, Homo sapiens
cggttattagaggtcatttatagc

SEQ ID NO: 28420 - DNA, 24 bp, Homo sapiens
tcggttattagaggtcatttatag

SEQ ID NO: 28421 - DNA, 24 bp, Homo sapiens
gtatttttcagatatgaagcaaca

SEQ ID NO: 28422 - DNA, 24 bp, Homo sapiens
tgtatttttcagatatgaagcaac

SEQ ID NO: 28423 - DNA, 24 bp, Homo sapiens
ttgtatttttcagatatgaagcaa

SEQ ID NO: 28424 - DNA, 24 bp, Homo sapiens
agatgccaaaaattaaagagactg

SEQ ID NO: 28425 - DNA, 24 bp, Homo sapiens
cagatgccaaaaattaaagagact

SEQ ID NO: 28426 - DNA, 24 bp, Homo sapiens
acagatgccaaaaattaaagagac

SEQ ID NO: 28427 - DNA, 25 bp, Homo sapiens
ggatttcagtcacccacagatgcca

SEQ ID NO: 28428 - DNA, 23 bp, Homo sapiens
ggcggcaggctggaggacactaa

SEQ ID NO: 28429 - DNA, 25 bp, Homo sapiens
ctgagattgctgtgaatgccgtcct

SEQ ID NO: 28430 - DNA, 25 bp, Homo sapiens
ggaatttcagtgaccttacagattt

SEQ ID NO: 28431 - DNA, 23 bp, Homo sapiens
ttggtagaaatcgtctatggatc

SEQ ID NO: 28432 - DNA, 23 bp, Homo sapiens
aggaaactgacatctttacaatt

SEQ ID NO: 28433 - DNA, 25 bp, Homo sapiens
ctacaagatcaatggcaccaccacc

SEQ ID NO: 28434 - DNA, 24 bp, Homo sapiens
ctcgtcaggctacaacttcaggtt

SEQ ID NO: 28435 - DNA, 23 bp, Homo sapiens
ggactgtgacctggacctgcctg

SEQ ID NO: 28436 - DNA, 23 bp, Homo sapiens
ggtccgccctctgggactacgag

SEQ ID NO: 28437 - DNA, 23 bp, Homo sapiens
gccgccgcccagcccaagtaccc

SEQ ID NO: 28438 - DNA, 23 bp, Homo sapiens
gcgaccgcccggcgcctggcccg

SEQ ID NO: 28439 - DNA, 25 bp, Homo sapiens
acaccacatccacctgtattgccac

SEQ ID NO: 28440 - DNA, 23 bp, Homo sapiens
gacttctggcggctggttgactc

SEQ ID NO: 28441 - DNA, 23 bp, Homo sapiens
tcggctgaatgcgtcttcttggc

SEQ ID NO: 28442 - DNA, 24 bp, Homo sapiens
tttctctttaggcagaagtttcta

SEQ ID NO: 28443 - DNA, 24 bp, Homo sapiens
ttttctctttaggcagaagtttct

SEQ ID NO: 28444 - DNA, 24 bp, Homo sapiens
attttctctttaggcagaagtttc

SEQ ID NO: 28445 - DNA, 24 bp, Homo sapiens
ctataaaacagagtaaatggtttt

SEQ ID NO: 28446 - DNA, 24 bp, Homo sapiens
actataaaacagagtaaatggttt

SEQ ID NO: 28447 - DNA, 24 bp, Homo sapiens
aactataaaacagagtaaatggtt

SEQ ID NO: 28448 - DNA, 24 bp, Homo sapiens
cggcggcaggtggtggagaagttc

SEQ ID NO: 28449 - DNA, 24 bp, Homo sapiens
gtggacagcgtagcagtggaggag

SEQ ID NO: 28450 - DNA, 24 bp, Homo sapiens
ggaggcagtggctacaactcggac

SEQ ID NO: 28451 - DNA, 24 bp, Homo sapiens
ccttctctgttccactggcgtatt

SEQ ID NO: 28452 - DNA, 23 bp, Homo sapiens
cgtttccagtcaccgcttctttg

SEQ ID NO: 28453 - DNA, 23 bp, Homo sapiens
catgagctggctggaggagaacg

SEQ ID NO: 28454 - DNA, 24 bp, Homo sapiens
ggcagcagcagagtgaccaaatcc

SEQ ID NO: 28455 - DNA, 24 bp, Homo sapiens
gggcagcagcagagtgaccaaatc

SEQ ID NO: 28456 - DNA, 24 bp, Homo sapiens
tgggcagcagcagagtgaccaaat

SEQ ID NO: 28457 - DNA, 23 bp, Homo sapiens
gagcgtgacaaggcaaggcagga

SEQ ID NO: 28458 - DNA, 23 bp, Homo sapiens
gccgagaagaggaacctggagtt

SEQ ID NO: 28459 - DNA, 24 bp, Homo sapiens
gtgaaccttctggagctgacctgg

SEQ ID NO: 28460 - DNA, 24 bp, Homo sapiens
attattagaaggcaagctgtggac

SEQ ID NO: 28461 - DNA, 24 bp, Homo sapiens
aattattagaaggcaagctgtgga

SEQ ID NO: 28462 - DNA, 24 bp, Homo sapiens
gaattattagaaggcaagctgtgg

SEQ ID NO: 28463 - DNA, 23 bp, Homo sapiens
ctcccgccgccgctacctccctc

SEQ ID NO: 28464 - DNA, 23 bp, Homo sapiens
tggacgattcgggcctcatccgc

SEQ ID NO: 28465 - DNA, 23 bp, Homo sapiens
aggctgcagaaggatttgcccct

SEQ ID NO: 28466 - DNA, 24 bp, Homo sapiens
aaaagcagcaggcagcagtcccct

SEQ ID NO: 28467 - DNA, 24 bp, Homo sapiens
gaaaagcagcaggcagcagtcccc

SEQ ID NO: 28468 - DNA, 24 bp, Homo sapiens
ggaaaagcagcaggcagcagtccc

SEQ ID NO: 28469 - DNA, 24 bp, Homo sapiens
tctgcaaacagtgagctggaggat

SEQ ID NO: 28470 - DNA, 24 bp, Homo sapiens
ttctgcaaacagtgagctggagga

SEQ ID NO: 28471 - DNA, 24 bp, Homo sapiens
tttctgcaaacagtgagctggagg

SEQ ID NO: 28472 - DNA, 24 bp, Homo sapiens
ttttccctcagtacaatgtggtga

SEQ ID NO: 28473 - DNA, 24 bp, Homo sapiens
tttttccctcagtacaatgtggtg

SEQ ID NO: 28474 - DNA, 24 bp, Homo sapiens
ttttttccctcagtacaatgtggt

SEQ ID NO: 28475 - DNA, 25 bp, Homo sapiens
ccatgatgaggaacagtgtcttgct

SEQ ID NO: 28476 - DNA, 23 bp, Homo sapiens
agctcactgcaacctccacttct

SEQ ID NO: 28477 - DNA, 25 bp, Homo sapiens
tcaactgtactgtgaagcactgatt

SEQ ID NO: 28478 - DNA, 23 bp, Homo sapiens
gtgttgtgcctgttcacggtgcc

SEQ ID NO: 28479 - DNA, 25 bp, Homo sapiens
tcctctcaggtctctagcattaggc

SEQ ID NO: 28480 - DNA, 23 bp, Homo sapiens
agtgatttggtgtctgggagccc

SEQ ID NO: 28481 - DNA, 25 bp, Homo sapiens
ggcagtgttgaagatgaggagaaga

SEQ ID NO: 28482 - DNA, 25 bp, Homo sapiens
tcgctgcccaaatcattcaagagga

SEQ ID NO: 28483 - DNA, 25 bp, Homo sapiens
cacagccaccacacagaagaaacct

SEQ ID NO: 28484 - DNA, 24 bp, Homo sapiens
ttgggaaaaaggttcaagaagaat

SEQ ID NO: 28485 - DNA, 24 bp, Homo sapiens
tttgggaaaaaggttcaagaagaa

SEQ ID NO: 28486 - DNA, 24 bp, Homo sapiens
gtttgggaaaaaggttcaagaaga

SEQ ID NO: 28487 - DNA, 24 bp, Homo sapiens
ggaaggaaaagattttaatgtaga

SEQ ID NO: 28488 - DNA, 24 bp, Homo sapiens
tggaaggaaaagattttaatgtag

SEQ ID NO: 28489 - DNA, 24 bp, Homo sapiens
atggaaggaaaagattttaatgta

SEQ ID NO: 28490 - DNA, 24 bp, Homo sapiens
tgataaaccaggttgcaataaatt

SEQ ID NO: 28491 - DNA, 24 bp, Homo sapiens
ctgataaaccaggttgcaataaat

SEQ ID NO: 28492 - DNA, 24 bp, Homo sapiens
gctgataaaccaggttgcaataaa

SEQ ID NO: 28493 - DNA, 24 bp, Homo sapiens
tatttttctaggaaaagccagcca

SEQ ID NO: 28494 - DNA, 24 bp, Homo sapiens
ttatttttctaggaaaagccagcc

SEQ ID NO: 28495 - DNA, 24 bp, Homo sapiens
cttatttttctaggaaaagccagc

SEQ ID NO: 28496 - DNA, 23 bp, Homo sapiens
ctggagctggagaggcaggcgtg

SEQ ID NO: 28497 - DNA, 23 bp, Homo sapiens
aaggaggaggcgtggctgctgaa

SEQ ID NO: 28498 - DNA, 25 bp, Homo sapiens
aggagattgagctggtcattcaccg

SEQ ID NO: 28499 - DNA, 24 bp, Homo sapiens
aatggaaaaagagaaatatggccg

SEQ ID NO: 28500 - DNA, 24 bp, Homo sapiens
gaatggaaaaagagaaatatggcc

SEQ ID NO: 28501 - DNA, 24 bp, Homo sapiens
agaatggaaaaagagaaatatggc

SEQ ID NO: 28502 - DNA, 24 bp, Homo sapiens
tgagtatgcaggccgggccagtct

SEQ ID NO: 28503 - DNA, 24 bp, Homo sapiens
ctgagtatgcaggccgggccagtc

SEQ ID NO: 28504 - DNA, 24 bp, Homo sapiens
cctgagtatgcaggccgggccagt

SEQ ID NO: 28505 - DNA, 24 bp, Homo sapiens
cttggagaaaggtagggaagccca

SEQ ID NO: 28506 - DNA, 24 bp, Homo sapiens
acttggagaaaggtagggaagccc

SEQ ID NO: 28507 - DNA, 24 bp, Homo sapiens
cacttggagaaaggtagggaagcc

SEQ ID NO: 28508 - DNA, 24 bp, Homo sapiens
tctcgaaagtctacgccgtccaca

SEQ ID NO: 28509 - DNA, 24 bp, Homo sapiens
gcagcaggcagagatgtcagagat

SEQ ID NO: 28510 - DNA, 24 bp, Homo sapiens
gctctcacctctgacccaaagccc

SEQ ID NO: 28511 - DNA, 24 bp, Homo sapiens
accaggctatgatggaggctacga

SEQ ID NO: 28512 - DNA, 24 bp, Homo sapiens
tccaggtctccatgacaactgcca

SEQ ID NO: 28513 - DNA, 24 bp, Homo sapiens
ccagcacccacctcaccgtcatcg

SEQ ID NO: 28514 - DNA, 24 bp, Homo sapiens
taaacaggagcgacactgatgaca

SEQ ID NO: 28515 - DNA, 24 bp, Homo sapiens
ataaacaggagcgacactgatgac

SEQ ID NO: 28516 - DNA, 24 bp, Homo sapiens
tataaacaggagcgacactgatga

SEQ ID NO: 28517 - DNA, 24 bp, Homo sapiens
aatgcctgaagccaaccaactaca

SEQ ID NO: 28518 - DNA, 24 bp, Homo sapiens
aaggtggagttggtgctgtcacaa

SEQ ID NO: 28519 - DNA, 25 bp, Homo sapiens
gctgaagaatgatgtgtcggaagaa

SEQ ID NO: 28520 - DNA, 23 bp, Homo sapiens
caaggagaaggagcagcagcagc

SEQ ID NO: 28521 - DNA, 24 bp, Homo sapiens
gcaggcggaagaaggatgtggatg

SEQ ID NO: 28522 - DNA, 25 bp, Homo sapiens
gtgccaaccagtgatgaggaggatg

SEQ ID NO: 28523 - DNA, 24 bp, Homo sapiens
gagctgtgcttgtggctgcggctg

SEQ ID NO: 28524 - DNA, 24 bp, Homo sapiens
cagcctcatctgtttgcggatcag

SEQ ID NO: 28525 - DNA, 24 bp, Homo sapiens
catgttggaaggtaaatcctttag

SEQ ID NO: 28526 - DNA, 24 bp, Homo sapiens
acatgttggaaggtaaatccttta

SEQ ID NO: 28527 - DNA, 24 bp, Homo sapiens
tacatgttggaaggtaaatccttt

SEQ ID NO: 28528 - DNA, 24 bp, Homo sapiens
gagaaattcagaattagaagtgcg

SEQ ID NO: 28529 - DNA, 24 bp, Homo sapiens
agagaaattcagaattagaagtgc

SEQ ID NO: 28530 - DNA, 24 bp, Homo sapiens
gagagaaattcagaattagaagtg

SEQ ID NO: 28531 - DNA, 24 bp, Homo sapiens
acattagataggttcacatagaca

SEQ ID NO: 28532 - DNA, 24 bp, Homo sapiens
aacattagataggttcacatagac

SEQ ID NO: 28533 - DNA, 24 bp, Homo sapiens
caacattagataggttcacataga

SEQ ID NO: 28534 - DNA, 24 bp, Homo sapiens
tggagcaaaagatgaataatgtga

SEQ ID NO: 28535 - DNA, 24 bp, Homo sapiens
gtggagcaaaagatgaataatgtg

SEQ ID NO: 28536 - DNA, 24 bp, Homo sapiens
ggtggagcaaaagatgaataatgt

SEQ ID NO: 28537 - DNA, 24 bp, Homo sapiens
ttgatacataggatatccaccttt

SEQ ID NO: 28538 - DNA, 24 bp, Homo sapiens
tttgatacataggatatccacctt

SEQ ID NO: 28539 - DNA, 24 bp, Homo sapiens
atttgatacataggatatccacct

SEQ ID NO: 28540 - DNA, 24 bp, Homo sapiens
atggaaggaagaaaagctttgacc

SEQ ID NO: 28541 - DNA, 24 bp, Homo sapiens
tatggaaggaagaaaagctttgac

SEQ ID NO: 28542 - DNA, 24 bp, Homo sapiens
atatggaaggaagaaaagctttga

SEQ ID NO: 28543 - DNA, 24 bp, Homo sapiens
cggtagctcagagaagcgccgtcg

SEQ ID NO: 28544 - DNA, 24 bp, Homo sapiens
ttggagcggctacttaatgccggt

SEQ ID NO: 28545 - DNA, 24 bp, Homo sapiens
gagctgggggcagagagccgcagg

SEQ ID NO: 28546 - DNA, 25 bp, Homo sapiens
gctgtgattcaaccactgtctgtcc

SEQ ID NO: 28547 - DNA, 25 bp, Homo sapiens
atatctctgccgacctgatggaacc

SEQ ID NO: 28548 - DNA, 23 bp, Homo sapiens
caggtggtggttctggagtgccg

SEQ ID NO: 28549 - DNA, 24 bp, Homo sapiens
attttgaggagcttttcctaaaag

SEQ ID NO: 28550 - DNA, 24 bp, Homo sapiens
gattttgaggagcttttcctaaaa

SEQ ID NO: 28551 - DNA, 24 bp, Homo sapiens
ggattttgaggagcttttcctaaa

SEQ ID NO: 28552 - DNA, 24 bp, Homo sapiens
ggaagcaaaagaaccgatgacaag

SEQ ID NO: 28553 - DNA, 24 bp, Homo sapiens
aggaagcaaaagaaccgatgacaa

SEQ ID NO: 28554 - DNA, 24 bp, Homo sapiens
aaggaagcaaaagaaccgatgaca

SEQ ID NO: 28555 - DNA, 25 bp, Homo sapiens
gtgtgctcggtatgataatgccttc

SEQ ID NO: 28556 - DNA, 24 bp, Homo sapiens
cgtcaaccaccaggatgaagactt

SEQ ID NO: 28557 - DNA, 23 bp, Homo sapiens
cattgcctgtgcctgcgataacc

SEQ ID NO: 28558 - DNA, 24 bp, Homo sapiens
ttttcttataggtgttacctcatt

SEQ ID NO: 28559 - DNA, 24 bp, Homo sapiens
cttttcttataggtgttacctcat

SEQ ID NO: 28560 - DNA, 24 bp, Homo sapiens
acttttcttataggtgttacctca

SEQ ID NO: 28561 - DNA, 25 bp, Homo sapiens
ttggtgtcaggatgatgctggcttc

SEQ ID NO: 28562 - DNA, 24 bp, Homo sapiens
cctctggtagaattcggctgtgaa

SEQ ID NO: 28563 - DNA, 23 bp, Homo sapiens
tgagttacggaggattccttctt

SEQ ID NO: 28564 - DNA, 24 bp, Homo sapiens
ttacagaacttgtgagttaatttt

SEQ ID NO: 28565 - DNA, 24 bp, Homo sapiens
attacagaacttgtgagttaattt

SEQ ID NO: 28566 - DNA, 24 bp, Homo sapiens
gattacagaacttgtgagttaatt

SEQ ID NO: 28567 - DNA, 24 bp, Homo sapiens
atacctttaaggtaacaacattct

SEQ ID NO: 28568 - DNA, 24 bp, Homo sapiens
catacctttaaggtaacaacattc

SEQ ID NO: 28569 - DNA, 24 bp, Homo sapiens
tcatacctttaaggtaacaacatt

SEQ ID NO: 28570 - DNA, 24 bp, Homo sapiens
ggactgataacgaagaccaggagg

SEQ ID NO: 28571 - DNA, 23 bp, Homo sapiens
gggaagaggacgaaggaaccagc

SEQ ID NO: 28572 - DNA, 25 bp, Homo sapiens
ctgaccagctcggtagaagatgtgt

SEQ ID NO: 28573 - DNA, 24 bp, Homo sapiens
acaaatgacaggtaattaaatgtg

SEQ ID NO: 28574 - DNA, 24 bp, Homo sapiens
cacaaatgacaggtaattaaatgt

SEQ ID NO: 28575 - DNA, 24 bp, Homo sapiens
ccacaaatgacaggtaattaaatg

SEQ ID NO: 28576 - DNA, 24 bp, Homo sapiens
aaaaacgaaaagtgtgactgaaaa

SEQ ID NO: 28577 - DNA, 24 bp, Homo sapiens
taaaaacgaaaagtgtgactgaaa

SEQ ID NO: 28578 - DNA, 24 bp, Homo sapiens
ttaaaaacgaaaagtgtgactgaa

SEQ ID NO: 28579 - DNA, 24 bp, Homo sapiens
tttgattgcagatattatagaaca

SEQ ID NO: 28580 - DNA, 24 bp, Homo sapiens
ttttgattgcagatattatagaac

SEQ ID NO: 28581 - DNA, 24 bp, Homo sapiens
gttttgattgcagatattatagaa

SEQ ID NO: 28582 - DNA, 23 bp, Homo sapiens
gctgctgctacagtgcgacaagt

SEQ ID NO: 28583 - DNA, 25 bp, Homo sapiens
tgttgtttttgagaggatggttgct

SEQ ID NO: 28584 - DNA, 25 bp, Homo sapiens
cggctacacttcacaaaagataata

SEQ ID NO: 28585 - DNA, 24 bp, Homo sapiens
agatatttgaggtaatgagaaaaa

SEQ ID NO: 28586 - DNA, 24 bp, Homo sapiens
cagatatttgaggtaatgagaaaa

SEQ ID NO: 28587 - DNA, 24 bp, Homo sapiens
acagatatttgaggtaatgagaaa

SEQ ID NO: 28588 - DNA, 24 bp, Homo sapiens
ataaactaaaggcaagtactgatt

SEQ ID NO: 28589 - DNA, 24 bp, Homo sapiens
gataaactaaaggcaagtactgat

SEQ ID NO: 28590 - DNA, 24 bp, Homo sapiens
tgataaactaaaggcaagtactga

SEQ ID NO: 28591 - DNA, 23 bp, Homo sapiens
cctggctggctgaggttgaaggc

SEQ ID NO: 28592 - DNA, 23 bp, Homo sapiens
gccagaacccacccacagtcaac

SEQ ID NO: 28593 - DNA, 25 bp, Homo sapiens
tggcagttacacagaggagcagagt

SEQ ID NO: 28594 - DNA, 23 bp, Homo sapiens
gccagaacccacccacagtcaac

SEQ ID NO: 28595 - DNA, 25 bp, Homo sapiens
tggcagttacacagaggagcagagt

SEQ ID NO: 28596 - DNA, 25 bp, Homo sapiens
cgacgagtttgatgatgaggagccc

SEQ ID NO: 28597 - DNA, 24 bp, Homo sapiens
aatactttcaggtgaatccagaaa

SEQ ID NO: 28598 - DNA, 24 bp, Homo sapiens
aaatactttcaggtgaatccagaa

SEQ ID NO: 28599 - DNA, 24 bp, Homo sapiens
aaaatactttcaggtgaatccaga

SEQ ID NO: 28600 - DNA, 24 bp, Homo sapiens
catttaaagaggtacagaataatc

SEQ ID NO: 28601 - DNA, 24 bp, Homo sapiens
ccatttaaagaggtacagaataat

SEQ ID NO: 28602 - DNA, 24 bp, Homo sapiens
tccatttaaagaggtacagaataa

SEQ ID NO: 28603 - DNA, 24 bp, Homo sapiens
ctttgaaaaaggtaaaagccttag

SEQ ID NO: 28604 - DNA, 24 bp, Homo sapiens
gctttgaaaaaggtaaaagcctta

SEQ ID NO: 28605 - DNA, 24 bp, Homo sapiens
tgctttgaaaaaggtaaaagcctt

SEQ ID NO: 28606 - DNA, 24 bp, Homo sapiens
ctctataggaaatatgaaatgcaa

SEQ ID NO: 28607 - DNA, 24 bp, Homo sapiens
gctctataggaaatatgaaatgca

SEQ ID NO: 28608 - DNA, 24 bp, Homo sapiens
agctctataggaaatatgaaatgc

SEQ ID NO: 28609 - DNA, 24 bp, Homo sapiens
gcaggtatctggacctcagccatg

SEQ ID NO: 28610 - DNA, 24 bp, Homo sapiens
agcaggtatctggacctcagccat

SEQ ID NO: 28611 - DNA, 24 bp, Homo sapiens
cagcaggtatctggacctcagcca

SEQ ID NO: 28612 - DNA, 24 bp, Homo sapiens
aagaaaaagagatgtgggcgctat

SEQ ID NO: 28613 - DNA, 24 bp, Homo sapiens
aaagaaaaagagatgtgggcgcta

SEQ ID NO: 28614 - DNA, 24 bp, Homo sapiens
taaagaaaaagagatgtgggcgct

SEQ ID NO: 28615 - DNA, 23 bp, Homo sapiens
tttagagatgcttgtgggactgc

SEQ ID NO: 28616 - DNA, 25 bp, Homo sapiens
tccttctctcctgctacccaactca

SEQ ID NO: 28617 - DNA, 23 bp, Homo sapiens
aatgcaactgcagaagcaacatg

SEQ ID NO: 28618 - DNA, 24 bp, Homo sapiens
aatgtgacaagttcttctacgccg

SEQ ID NO: 28619 - DNA, 24 bp, Homo sapiens
ggccgattcccacgtgaagatctg

SEQ ID NO: 28620 - DNA, 24 bp, Homo sapiens
ccctggctgggctgctggaaggcc

SEQ ID NO: 28621 - DNA, 24 bp, Homo sapiens
tgtgagggtcttccatctgaggca

SEQ ID NO: 28622 - DNA, 25 bp, Homo sapiens
tggcagtcgtggaggctataatgga

SEQ ID NO: 28623 - DNA, 25 bp, Homo sapiens
acagcattagcaactcttcttcgga

SEQ ID NO: 28624 - DNA, 23 bp, Homo sapiens
cagcagcaaccaccaaaccaggg

SEQ ID NO: 28625 - DNA, 25 bp, Homo sapiens
ggtcggaatcctatggttcaacagg

SEQ ID NO: 28626 - DNA, 24 bp, Homo sapiens
acctcaccaacaagtctcctgcct

SEQ ID NO: 28627 - DNA, 25 bp, Homo sapiens
ctccatgttgaccaggctagtctca

SEQ ID NO: 28628 - DNA, 23 bp, Homo sapiens
ggattacagtgcgtcaccatgcc

SEQ ID NO: 28629 - DNA, 25 bp, Homo sapiens
acaactttcaagggaacaagagaca

SEQ ID NO: 28630 - DNA, 24 bp, Homo sapiens
aaaagtccaagcttctgacaaggc

SEQ ID NO: 28631 - DNA, 24 bp, Homo sapiens
gaaaagtccaagcttctgacaagg

SEQ ID NO: 28632 - DNA, 24 bp, Homo sapiens
agaaaagtccaagcttctgacaag

SEQ ID NO: 28633 - DNA, 23 bp, Homo sapiens
aggacttgcctggtgtgcctgaa

SEQ ID NO: 28634 - DNA, 25 bp, Homo sapiens
aagaagcccataaataaacaaggag

SEQ ID NO: 28635 - DNA, 23 bp, Homo sapiens
caaaggaaaataccagaaagatt

SEQ ID NO: 28636 - DNA, 24 bp, Homo sapiens
aaaacaaatagctcatatataaat

SEQ ID NO: 28637 - DNA, 24 bp, Homo sapiens
aaaaacaaatagctcatatataaa

SEQ ID NO: 28638 - DNA, 24 bp, Homo sapiens
taaaaacaaatagctcatatataa

SEQ ID NO: 28639 - DNA, 24 bp, Homo sapiens
ctcccagaaaggtaaggctgcctg

SEQ ID NO: 28640 - DNA, 24 bp, Homo sapiens
tctcccagaaaggtaaggctgcct

SEQ ID NO: 28641 - DNA, 24 bp, Homo sapiens
atctcccagaaaggtaaggctgcc

SEQ ID NO: 28642 - DNA, 25 bp, Homo sapiens
gatggtccagagaactactgctcat

SEQ ID NO: 28643 - DNA, 25 bp, Homo sapiens
ccaatgtcaagccagactcctcctt

SEQ ID NO: 28644 - DNA, 25 bp, Homo sapiens
agatgatggtgatggtaacagcctc

SEQ ID NO: 28645 - DNA, 23 bp, Homo sapiens
cagcctgggcaacagagcgagac

SEQ ID NO: 28646 - DNA, 25 bp, Homo sapiens
tcctattaactgacaactaagaagg

SEQ ID NO: 28647 - DNA, 24 bp, Homo sapiens
ggtaaaagaagcatctactacaag

SEQ ID NO: 28648 - DNA, 24 bp, Homo sapiens
aggtaaaagaagcatctactacaa

SEQ ID NO: 28649 - DNA, 24 bp, Homo sapiens
caggtaaaagaagcatctactaca

SEQ ID NO: 28650 - DNA, 25 bp, Homo sapiens
aaggacaaggaagtcggaggctgat

SEQ ID NO: 28651 - DNA, 25 bp, Homo sapiens
tcagcctgggaaacacagcatcttc

SEQ ID NO: 28652 - DNA, 25 bp, Homo sapiens
atccaagatcataggcaacaccgtg

SEQ ID NO: 28653 - DNA, 24 bp, Homo sapiens
ctctctctcagcaattcagttttg

SEQ ID NO: 28654 - DNA, 24 bp, Homo sapiens
tctctctctcagcaattcagtttt

SEQ ID NO: 28655 - DNA, 24 bp, Homo sapiens
ttctctctctcagcaattcagttt

SEQ ID NO: 28656 - DNA, 24 bp, Homo sapiens
ttattgatgaggtaattgataaag

SEQ ID NO: 28657 - DNA, 24 bp, Homo sapiens
tttattgatgaggtaattgataaa

SEQ ID NO: 28658 - DNA, 24 bp, Homo sapiens
ttttattgatgaggtaattgataa

SEQ ID NO: 28659 - DNA, 24 bp, Homo sapiens
ccatttgcaagaacaaaattaatc

SEQ ID NO: 28660 - DNA, 24 bp, Homo sapiens
cccatttgcaagaacaaaattaat

SEQ ID NO: 28661 - DNA, 24 bp, Homo sapiens
tcccatttgcaagaacaaaattaa

SEQ ID NO: 28662 - DNA, 24 bp, Homo sapiens
ggattacaaatgtgaagtaacatc

SEQ ID NO: 28663 - DNA, 24 bp, Homo sapiens
aggattacaaatgtgaagtaacat

SEQ ID NO: 28664 - DNA, 24 bp, Homo sapiens
aaggattacaaatgtgaagtaaca

SEQ ID NO: 28665 - DNA, 24 bp, Homo sapiens
aaagaaaaagggaacagcctgact

SEQ ID NO: 28666 - DNA, 24 bp, Homo sapiens
caaagaaaaagggaacagcctgac

SEQ ID NO: 28667 - DNA, 24 bp, Homo sapiens
acaaagaaaaagggaacagcctga

SEQ ID NO: 28668 - DNA, 24 bp, Homo sapiens
agaagttccagtatgacatcgttg

SEQ ID NO: 28669 - DNA, 24 bp, Homo sapiens
gagaagttccagtatgacatcgtt

SEQ ID NO: 28670 - DNA, 24 bp, Homo sapiens
ggagaagttccagtatgacatcgt

SEQ ID NO: 28671 - DNA, 24 bp, Homo sapiens
actagctcaaggtaaaacttgctt

SEQ ID NO: 28672 - DNA, 24 bp, Homo sapiens
gactagctcaaggtaaaacttgct

SEQ ID NO: 28673 - DNA, 24 bp, Homo sapiens
agactagctcaaggtaaaacttgc

SEQ ID NO: 28674 - DNA, 24 bp, Homo sapiens
ggcaaaaaatgatccgatagaatt

SEQ ID NO: 28675 - DNA, 24 bp, Homo sapiens
tggcaaaaaatgatccgatagaat

SEQ ID NO: 28676 - DNA, 24 bp, Homo sapiens
atggcaaaaaatgatccgatagaa

SEQ ID NO: 28677 - DNA, 24 bp, Homo sapiens
tctcttttcagttttagatgactt

SEQ ID NO: 28678 - DNA, 24 bp, Homo sapiens
ttctcttttcagttttagatgact

SEQ ID NO: 28679 - DNA, 24 bp, Homo sapiens
attctcttttcagttttagatgac

SEQ ID NO: 28680 - DNA, 24 bp, Homo sapiens
gacagcagcaggaggcctagaagg

SEQ ID NO: 28681 - DNA, 24 bp, Homo sapiens
tgacagcagcaggaggcctagaag

SEQ ID NO: 28682 - DNA, 24 bp, Homo sapiens
gtgacagcagcaggaggcctagaa

SEQ ID NO: 28683 - DNA, 25 bp, Homo sapiens
gcagagacaggcttcaagaacgaga

SEQ ID NO: 28684 - DNA, 24 bp, Homo sapiens
agattgcgagaacgagaacgagag

SEQ ID NO: 28685 - DNA, 25 bp, Homo sapiens
gggacagggacagagacagagacag

SEQ ID NO: 28686 - DNA, 24 bp, Homo sapiens
tcacccaacaggtaacaaacctga

SEQ ID NO: 28687 - DNA, 24 bp, Homo sapiens
ctcacccaacaggtaacaaacctg

SEQ ID NO: 28688 - DNA, 24 bp, Homo sapiens
cctcacccaacaggtaacaaacct

SEQ ID NO: 28689 - DNA, 24 bp, Homo sapiens
ttctttaaaagcaaacagaaaaag

SEQ ID NO: 28690 - DNA, 24 bp, Homo sapiens
cttctttaaaagcaaacagaaaaa

SEQ ID NO: 28691 - DNA, 24 bp, Homo sapiens
ccttctttaaaagcaaacagaaaa

SEQ ID NO: 28692 - DNA, 24 bp, Homo sapiens
gagaaactcaagtatgaaaacatt

SEQ ID NO: 28693 - DNA, 24 bp, Homo sapiens
ggagaaactcaagtatgaaaacat

SEQ ID NO: 28694 - DNA, 24 bp, Homo sapiens
tggagaaactcaagtatgaaaaca

SEQ ID NO: 28695 - DNA, 24 bp, Homo sapiens
tgcttcatcaggtactaatgaggg

SEQ ID NO: 28696 - DNA, 24 bp, Homo sapiens
ttgcttcatcaggtactaatgagg

SEQ ID NO: 28697 - DNA, 24 bp, Homo sapiens
tttgcttcatcaggtactaatgag

SEQ ID NO: 28698 - DNA, 24 bp, Homo sapiens
attagaccaagctcagtggtctct

SEQ ID NO: 28699 - DNA, 24 bp, Homo sapiens
aattagaccaagctcagtggtctc

SEQ ID NO: 28700 - DNA, 24 bp, Homo sapiens
aaattagaccaagctcagtggtct

SEQ ID NO: 28701 - DNA, 23 bp, Homo sapiens
tcttccacgcaccaccaccacta

SEQ ID NO: 28702 - DNA, 24 bp, Homo sapiens
aagaaggctgtaggaagactgtgc

SEQ ID NO: 28703 - DNA, 25 bp, Homo sapiens
gaccagagtcagcaacttcctgtgt

SEQ ID NO: 28704 - DNA, 24 bp, Homo sapiens
ttaatttttagcatattattaagt

SEQ ID NO: 28705 - DNA, 24 bp, Homo sapiens
tttaatttttagcatattattaag

SEQ ID NO: 28706 - DNA, 24 bp, Homo sapiens
ttttaatttttagcatattattaa

SEQ ID NO: 28707 - DNA, 24 bp, Homo sapiens
ggcggccagagaaatgctacactc

SEQ ID NO: 28708 - DNA, 24 bp, Homo sapiens
cggcggccagagaaatgctacact

SEQ ID NO: 28709 - DNA, 24 bp, Homo sapiens
acggcggccagagaaatgctacac

SEQ ID NO: 28710 - DNA, 24 bp, Homo sapiens
agaactttaaggtaagatcttggc

SEQ ID NO: 28711 - DNA, 24 bp, Homo sapiens
gagaactttaaggtaagatcttgg

SEQ ID NO: 28712 - DNA, 24 bp, Homo sapiens
tgagaactttaaggtaagatcttg

SEQ ID NO: 28713 - DNA, 25 bp, Homo sapiens
tgaggaaccttatacggagacagag

SEQ ID NO: 28714 - DNA, 23 bp, Homo sapiens
gccctccacctcggtccctctag

SEQ ID NO: 28715 - DNA, 25 bp, Homo sapiens
acaagaggcaagtgagtctgatgaa

SEQ ID NO: 28716 - DNA, 24 bp, Homo sapiens
tacctttacaagtaagttttccat

SEQ ID NO: 28717 - DNA, 24 bp, Homo sapiens
ttacctttacaagtaagttttcca

SEQ ID NO: 28718 - DNA, 24 bp, Homo sapiens
attacctttacaagtaagttttcc

SEQ ID NO: 28719 - DNA, 25 bp, Homo sapiens
accacccacttgtaaatgagaacat

SEQ ID NO: 28720 - DNA, 25 bp, Homo sapiens
atggctgtgtagtatttcatggtgt

SEQ ID NO: 28721 - DNA, 25 bp, Homo sapiens
tgttgctgcaaaggacatggtttca

SEQ ID NO: 28722 - DNA, 24 bp, Homo sapiens
tttctttatagtctggagcaaaag

SEQ ID NO: 28723 - DNA, 24 bp, Homo sapiens
ctttctttatagtctggagcaaaa

SEQ ID NO: 28724 - DNA, 24 bp, Homo sapiens
ctttctttatagtctggagcaaaa

SEQ ID NO: 28725 - DNA, 24 bp, Homo sapiens
ggcgagatggatgatacaggagca

SEQ ID NO: 28726 - DNA, 25 bp, Homo sapiens
gggtgagccaaatgaaagcagtcct

SEQ ID NO: 28727 - DNA, 25 bp, Homo sapiens
cacctgctccagataatggtacttc

SEQ ID NO: 28728 - DNA, 25 bp, Homo sapiens
gggtgagccaaatgaaagcagtcct

SEQ ID NO: 28729 - DNA, 24 bp, Homo sapiens
ggcgagatggatgatacaggagca

SEQ ID NO: 28730 - DNA, 25 bp, Homo sapiens
ggaggaggatggaggagtctggaac

SEQ ID NO: 28731 - DNA, 24 bp, Homo sapiens
tgcaggagcaggtcagcagattcc

SEQ ID NO: 28732 - DNA, 24 bp, Homo sapiens
gtgcaggagcaggtcagcagattc

SEQ ID NO: 28733 - DNA, 24 bp, Homo sapiens
ggtgcaggagcaggtcagcagatt

SEQ ID NO: 28734 - DNA, 24 bp, Homo sapiens
ccttctcctgagccatccactcgg

SEQ ID NO: 28735 - DNA, 23 bp, Homo sapiens
agcaagaacagcaagggtcggga

SEQ ID NO: 28736 - DNA, 25 bp, Homo sapiens
aagcagcagcctgaggaacataacc

SEQ ID NO: 28737 - DNA, 23 bp, Homo sapiens
ttcgtcgcctttgccacttgctg

SEQ ID NO: 28738 - DNA, 24 bp, Homo sapiens
ccttgagtcgagcagcgtcctttg

SEQ ID NO: 28739 - DNA, 24 bp, Homo sapiens
cctgggatggctgctggatcagta

SEQ ID NO: 28740 - DNA, 24 bp, Homo sapiens
gcctccggggtcccaacaccagac

SEQ ID NO: 28741 - DNA, 24 bp, Homo sapiens
cgcctccggggtcccaacaccaga

SEQ ID NO: 28742 - DNA, 24 bp, Homo sapiens
tcgcctccggggtcccaacaccag

SEQ ID NO: 28743 - DNA, 24 bp, Homo sapiens
ttgttcaagaggtaaacttatttt

SEQ ID NO: 28744 - DNA, 24 bp, Homo sapiens
gttgttcaagaggtaaacttattt

SEQ ID NO: 28745 - DNA, 24 bp, Homo sapiens
agttgttcaagaggtaaacttatt

SEQ ID NO: 28746 - DNA, 23 bp, Homo sapiens
ttctcgtgctgctgtggtctgtt

SEQ ID NO: 28747 - DNA, 25 bp, Homo sapiens
gcacaaggctggtgaatcaaataca

SEQ ID NO: 28748 - DNA, 25 bp, Homo sapiens
aagatgttgacaaagcattgagagc

SEQ ID NO: 28749 - DNA, 24 bp, Homo sapiens
atatatttcaggaccacattttaa

SEQ ID NO: 28750 - DNA, 24 bp, Homo sapiens
tatatatttcaggaccacatttta

SEQ ID NO: 28751 - DNA, 24 bp, Homo sapiens
ttatatatttcaggaccacatttt

SEQ ID NO: 28752 - DNA, 24 bp, Homo sapiens
acgcacacgaggtgaccaggcatt

SEQ ID NO: 28753 - DNA, 24 bp, Homo sapiens
gacgcacacgaggtgaccaggcat

SEQ ID NO: 28754 - DNA, 24 bp, Homo sapiens
cgacgcacacgaggtgaccaggca

SEQ ID NO: 28755 - DNA, 24 bp, Homo sapiens
tctcacagcaggaggtacagttcg

SEQ ID NO: 28756 - DNA, 24 bp, Homo sapiens
ttctcacagcaggaggtacagttc

SEQ ID NO: 28757 - DNA, 24 bp, Homo sapiens
cttctcacagcaggaggtacagtt

SEQ ID NO: 28758 - DNA, 25 bp, Homo sapiens
ggcgagattgttgtctacaccaagg

SEQ ID NO: 28759 - DNA, 25 bp, Homo sapiens
agagaatgtctgtggttgtgaggca

SEQ ID NO: 28760 - DNA, 23 bp, Homo sapiens
ctgcctcaccttcagcctcctct

SEQ ID NO: 28761 - DNA, 24 bp, Homo sapiens
tttatctgtaggtatcattaatgg

SEQ ID NO: 28762 - DNA, 24 bp, Homo sapiens
ttttatctgtaggtatcattaatg

SEQ ID NO: 28763 - DNA, 24 bp, Homo sapiens
tttttatctgtaggtatcattaat

SEQ ID NO: 28764 - DNA, 24 bp, Homo sapiens
tttattcccagattagaaatgata

SEQ ID NO: 28765 - DNA, 24 bp, Homo sapiens
ctttattcccagattagaaatgat

SEQ ID NO: 28766 - DNA, 24 bp, Homo sapiens
tctttattcccagattagaaatga

SEQ ID NO: 28767 - DNA, 24 bp, Homo sapiens
atcttaccaaaataaaagcttcga

SEQ ID NO: 28768 - DNA, 24 bp, Homo sapiens
tatcttaccaaaataaaagcttcg

SEQ ID NO: 28769 - DNA, 24 bp, Homo sapiens
atatcttaccaaaataaaagcttc

SEQ ID NO: 28770 - DNA, 24 bp, Homo sapiens
tggggggcttggttctgggagcct

SEQ ID NO: 28771 - DNA, 24 bp, Homo sapiens
gtggggggcttggttctgggagcc

SEQ ID NO: 28772 - DNA, 24 bp, Homo sapiens
agtggggggcttggttctgggagc

SEQ ID NO: 28773 - DNA, 23 bp, Homo sapiens
gcagccagcagcactcctgtgtt

SEQ ID NO: 28774 - DNA, 25 bp, Homo sapiens
ggtgaatgagtctgttgtacgctgt

SEQ ID NO: 28775 - DNA, 24 bp, Homo sapiens
ttcccgctcagcctccaactaaag

SEQ ID NO: 28776 - DNA, 23 bp, Homo sapiens
aactccaccctcatcacctgccc

SEQ ID NO: 28777 - DNA, 24 bp, Homo sapiens
cgccagtggacttcttcatcaatg

SEQ ID NO: 28778 - DNA, 23 bp, Homo sapiens
gacgaggtggctgtggctgagga

SEQ ID NO: 28779 - DNA, 23 bp, Homo sapiens
atggacaccgacacgctgacaca

SEQ ID NO: 28780 - DNA, 23 bp, Homo sapiens
cttgagtggttcgcctccagcac

SEQ ID NO: 28781 - DNA, 23 bp, Homo sapiens
ggacctggacgacacctcagtgg

SEQ ID NO: 28782 - DNA, 24 bp, Homo sapiens
tagagaccactggttcgcaggagg

SEQ ID NO: 28783 - DNA, 23 bp, Homo sapiens
gacacagcccctcccctcctgac

SEQ ID NO: 28784 - DNA, 23 bp, Homo sapiens
cagcccagcagccccctggaagg

SEQ ID NO: 28785 - DNA, 24 bp, Homo sapiens
aaaagtacaagagattaaaagatc

SEQ ID NO: 28786 - DNA, 24 bp, Homo sapiens
caaaagtacaagagattaaaagat

SEQ ID NO: 28787 - DNA, 24 bp, Homo sapiens
acaaaagtacaagagattaaaaga

SEQ ID NO: 28788 - DNA, 24 bp, Homo sapiens
ccattgtgccggttaatactcttc

SEQ ID NO: 28789 - DNA, 24 bp, Homo sapiens
gccattgtgccggttaatactctt

SEQ ID NO: 28790 - DNA, 24 bp, Homo sapiens
tgccattgtgccggttaatactct

SEQ ID NO: 28791 - DNA, 24 bp, Homo sapiens
ctttactccaggttctgacaaaga

SEQ ID NO: 28792 - DNA, 24 bp, Homo sapiens
tctttactccaggttctgacaaag

SEQ ID NO: 28793 - DNA, 24 bp, Homo sapiens
ctctttactccaggttctgacaaa

SEQ ID NO: 28794 - DNA, 24 bp, Homo sapiens
cagagcgccaggagcagcggcact

SEQ ID NO: 28795 - DNA, 24 bp, Homo sapiens
ccagagcgccaggagcagcggcac

SEQ ID NO: 28796 - DNA, 24 bp, Homo sapiens
cccagagcgccaggagcagcggca

SEQ ID NO: 28797 - DNA, 24 bp, Homo sapiens
cactgcctccaccaccattaccac

SEQ ID NO: 28798 - DNA, 24 bp, Homo sapiens
caccaccaccaccaccaccaccac

SEQ ID NO: 28799 - DNA, 24 bp, Homo sapiens
taaccaagccagggctgtggagta

SEQ ID NO: 28800 - DNA, 24 bp, Homo sapiens
cttggatggagaggttggtactgg

SEQ ID NO: 28801 - DNA, 24 bp, Homo sapiens
gcttggatggagaggttggtactg

SEQ ID NO: 28802 - DNA, 24 bp, Homo sapiens
agcttggatggagaggttggtact

SEQ ID NO: 28803 - DNA, 24 bp, Homo sapiens
gaaattgaattgtaagtgttaaaa

SEQ ID NO: 28804 - DNA, 24 bp, Homo sapiens
tgaaattgaattgtaagtgttaaa

SEQ ID NO: 28805 - DNA, 24 bp, Homo sapiens
ttgaaattgaattgtaagtgttaa

SEQ ID NO: 28806 - DNA, 23 bp, Homo sapiens
tccctccctcgccaatccggctc

SEQ ID NO: 28807 - DNA, 23 bp, Homo sapiens
cctgccgctccgccgctccgacc

SEQ ID NO: 28808 - DNA, 23 bp, Homo sapiens
gacgccttgcaggagggttcaaa

SEQ ID NO: 28809 - DNA, 23 bp, Homo sapiens
gcagtcctggcactccttgttcc

SEQ ID NO: 28810 - DNA, 25 bp, Homo sapiens
tggatcacaaggtcaggagttcaag

SEQ ID NO: 28811 - DNA, 25 bp, Homo sapiens
gtgctttggctacttctcctcttgc

SEQ ID NO: 28812 - DNA, 24 bp, Homo sapiens
agttcgaggaggcctttgcccagt

SEQ ID NO: 28813 - DNA, 24 bp, Homo sapiens
cagttcgaggaggcctttgcccag

SEQ ID NO: 28814 - DNA, 24 bp, Homo sapiens
gcagttcgaggaggcctttgccca

SEQ ID NO: 28815 - DNA, 23 bp, Homo sapiens
agatggagtctcgcactgtcgcc

SEQ ID NO: 28816 - DNA, 25 bp, Homo sapiens
tgcctacaatgacggatcaactgga

SEQ ID NO: 28817 - DNA, 24 bp, Homo sapiens
ttgtacgctgtgtaccttcgtgcc

SEQ ID NO: 28818 - DNA, 24 bp, Homo sapiens
gtcctgtctggggcaggtgacctg

SEQ ID NO: 28819 - DNA, 24 bp, Homo sapiens
agtcctgtctggggcaggtgacct

SEQ ID NO: 28820 - DNA, 24 bp, Homo sapiens
gagtcctgtctggggcaggtgacc

SEQ ID NO: 28821 - DNA, 24 bp, Homo sapiens
ggagtgtgcagtgcctgaggcttg

SEQ ID NO: 28822 - DNA, 24 bp, Homo sapiens
cggagtgtgcagtgcctgaggctt

SEQ ID NO: 28823 - DNA, 24 bp, Homo sapiens
acggagtgtgcagtgcctgaggct

SEQ ID NO: 28824 - DNA, 24 bp, Homo sapiens
gcttccctgcccagaatacacctg

SEQ ID NO: 28825 - DNA, 24 bp, Homo sapiens
tggtgtgtgatgggcagcctgact

SEQ ID NO: 28826 - DNA, 24 bp, Homo sapiens
gcctcctggtgctacagaactgcc

SEQ ID NO: 28827 - DNA, 24 bp, Homo sapiens
ggtgtgtgatggcagggaggattg

SEQ ID NO: 28828 - DNA, 24 bp, Homo sapiens
gtgaggtgctgggctgcgtggaac

SEQ ID NO: 28829 - DNA, 24 bp, Homo sapiens
gaatctgtgcagatggtgaccacc

SEQ ID NO: 28830 - DNA, 24 bp, Homo sapiens
ggagatgaacgccacaaagaccca

SEQ ID NO: 28831 - DNA, 24 bp, Homo sapiens
ggggagctggggctctgcgagcag

SEQ ID NO: 28832 - DNA, 24 bp, Homo sapiens
cgagcctcgggctgcgtgtgccag

SEQ ID NO: 28833 - DNA, 24 bp, Homo sapiens
atgccagtaatgatctgcggagcc

SEQ ID NO: 28834 - DNA, 24 bp, Homo sapiens
tggctgggctgtgtggtgactttg

SEQ ID NO: 28835 - DNA, 24 bp, Homo sapiens
ctgctctgggatggagggactcgg

SEQ ID NO: 28836 - DNA, 24 bp, Homo sapiens
ccagattccattccacagccaaga

SEQ ID NO: 28837 - DNA, 24 bp, Homo sapiens
gaatctgtgcagatggtgaccacc

SEQ ID NO: 28838 - DNA, 24 bp, Homo sapiens
gtgaggtgctgggctgcgtggaac

SEQ ID NO: 28839 - DNA, 24 bp, Homo sapiens
ctgacggagggtcggaaggactga

SEQ ID NO: 28840 - DNA, 24 bp, Homo sapiens
acgctcactcgctgggacaggcgg

SEQ ID NO: 28841 - DNA, 24 bp, Homo sapiens
gagctgctgctgcccgaggcggac

SEQ ID NO: 28842 - DNA, 24 bp, Homo sapiens
acttattatagccagtgatgcctt

SEQ ID NO: 28843 - DNA, 24 bp, Homo sapiens
tacttattatagccagtgatgcct

SEQ ID NO: 28844 - DNA, 24 bp, Homo sapiens
ttacttattatagccagtgatgcc

SEQ ID NO: 28845 - DNA, 23 bp, Homo sapiens
cggatggagctggagcagaaggt

SEQ ID NO: 28846 - DNA, 23 bp, Homo sapiens
ccagaaccgaggagcagatggct

SEQ ID NO: 28847 - DNA, 24 bp, Homo sapiens
gaagtggttctacgagcggttcgg

SEQ ID NO: 28848 - DNA, 24 bp, Homo sapiens
taacttataagtttcatgattttg

SEQ ID NO: 28849 - DNA, 24 bp, Homo sapiens
ttaacttataagtttcatgatttt

SEQ ID NO: 28850 - DNA, 24 bp, Homo sapiens
tttaacttataagtttcatgattt

SEQ ID NO: 28851 - DNA, 23 bp, Homo sapiens
ggtgatgtggtgtggtggtggtg

SEQ ID NO: 28852 - DNA, 24 bp, Homo sapiens
gcttccttgtaaccctgatgccca

SEQ ID NO: 28853 - DNA, 24 bp, Homo sapiens
ccctgctctctccctttccttact

SEQ ID NO: 28854 - DNA, 23 bp, Homo sapiens
ggcttccgcatcctcttccactt

SEQ ID NO: 28855 - DNA, 23 bp, Homo sapiens
ccttacctgtcaagagcatcgtg

SEQ ID NO: 28856 - DNA, 23 bp, Homo sapiens
tggtggtggtgtccatgctgaac

SEQ ID NO: 28857 - DNA, 24 bp, Homo sapiens
tgccaatgaaggtaagtgtaataa

SEQ ID NO: 28858 - DNA, 24 bp, Homo sapiens
atgccaatgaaggtaagtgtaata

SEQ ID NO: 28859 - DNA, 24 bp, Homo sapiens
tatgccaatgaaggtaagtgtaat

SEQ ID NO: 28860 - DNA, 24 bp, Homo sapiens
gtgaattgattgtgaaacagctga

SEQ ID NO: 28861 - DNA, 24 bp, Homo sapiens
ggtgaattgattgtgaaacagctg

SEQ ID NO: 28862 - DNA, 24 bp, Homo sapiens
aggtgaattgattgtgaaacagct

SEQ ID NO: 28863 - DNA, 25 bp, Homo sapiens
tggctgtgaacatttctgaggaggg

SEQ ID NO: 28864 - DNA, 23 bp, Homo sapiens
gaccatcctgcccatcctgccca

SEQ ID NO: 28865 - DNA, 23 bp, Homo sapiens
gcagcgaggagcagcacaagatt

SEQ ID NO: 28866 - DNA, 24 bp, Homo sapiens
ccgtgtgactgaggcagagattgt

SEQ ID NO: 28867 - DNA, 24 bp, Homo sapiens
gtcagcgtcaagtaccgtgggcag

SEQ ID NO: 28868 - DNA, 24 bp, Homo sapiens
ctggagagaggagaagcgggagtc

SEQ ID NO: 28869 - DNA, 25 bp, Homo sapiens
gccacctgcttaacagaagacaact

SEQ ID NO: 28870 - DNA, 25 bp, Homo sapiens
gggacatttctctcctgatgctgga

SEQ ID NO: 28871 - DNA, 23 bp, Homo sapiens
tgtcacccagcccagcctcccag

SEQ ID NO: 28872 - DNA, 25 bp, Homo sapiens
ccatcttgtccactactatatgcca

SEQ ID NO: 28873 - DNA, 24 bp, Homo sapiens
gccgaataggaacagctccagtct

SEQ ID NO: 28874 - DNA, 23 bp, Homo sapiens
cgacgcagaagatggctgatttc

SEQ ID NO: 28875 - DNA, 24 bp, Homo sapiens
cacctatgctgtctcctatgtgcc

SEQ ID NO: 28876 - DNA, 24 bp, Homo sapiens
aggaggctaaggtggttcccaaca

SEQ ID NO: 28877 - DNA, 24 bp, Homo sapiens
gtgggcgaggtgctggtctacatc

SEQ ID NO: 28878 - DNA, 24 bp, Homo sapiens
cctacattgaggtaatgactgttc

SEQ ID NO: 28879 - DNA, 24 bp, Homo sapiens
gcctacattgaggtaatgactgtt

SEQ ID NO: 28880 - DNA, 24 bp, Homo sapiens
tgcctacattgaggtaatgactgt

SEQ ID NO: 28881 - DNA, 24 bp, Homo sapiens
cgaggagatggagaagatgctgaa

SEQ ID NO: 28882 - DNA, 25 bp, Homo sapiens
tctgacagcatggagaccagcatct

SEQ ID NO: 28883 - DNA, 25 bp, Homo sapiens
gcacgcctatgatacgctgagtctg

SEQ ID NO: 28884 - DNA, 24 bp, Homo sapiens
ctttttcacagcatgtacaaacaa

SEQ ID NO: 28885 - DNA, 24 bp, Homo sapiens
actttttcacagcatgtacaaaca

SEQ ID NO: 28886 - DNA, 24 bp, Homo sapiens
gactttttcacagcatgtacaaac

SEQ ID NO: 28887 - DNA, 23 bp, Homo sapiens
accagtgaagccgtgacatcctg

SEQ ID NO: 28888 - DNA, 25 bp, Homo sapiens
ggttgattccatcctcttcagttgt

SEQ ID NO: 28889 - DNA, 24 bp, Homo sapiens
agtggtgcgatcacagcttactgc

SEQ ID NO: 28890 - DNA, 24 bp, Homo sapiens
ctttaattcagagagaaattaaga

SEQ ID NO: 28891 - DNA, 24 bp, Homo sapiens
tctttaattcagagagaaattaag

SEQ ID NO: 28892 - DNA, 24 bp, Homo sapiens
ttctttaattcagagagaaattaa

SEQ ID NO: 28893 - DNA, 24 bp, Homo sapiens
tctacacagatggctgcaagttgg

SEQ ID NO: 28894 - DNA, 24 bp, Homo sapiens
gtggtgttcgtggcaggtgatgat

SEQ ID NO: 28895 - DNA, 23 bp, Homo sapiens
tcgggactgcggagactacacac

SEQ ID NO: 28896 - DNA, 24 bp, Homo sapiens
ctcactgcaacttccaccttccga

SEQ ID NO: 28897 - DNA, 23 bp, Homo sapiens
caggctggagtgcagtggtgcaa

SEQ ID NO: 28898 - DNA, 24 bp, Homo sapiens
aagaacttaaagtaagatgaacag

SEQ ID NO: 28899 - DNA, 24 bp, Homo sapiens
aaagaacttaaagtaagatgaaca

SEQ ID NO: 28900 - DNA, 24 bp, Homo sapiens
aaaagaacttaaagtaagatgaac

SEQ ID NO: 28901 - DNA, 24 bp, Homo sapiens
aactgaatgaggttcttcagagca

SEQ ID NO: 28902 - DNA, 24 bp, Homo sapiens
gaactgaatgaggttcttcagagc

SEQ ID NO: 28903 - DNA, 24 bp, Homo sapiens
agaactgaatgaggttcttcagag

SEQ ID NO: 28904 - DNA, 24 bp, Homo sapiens
tgcaaaaattggctgcttacagaa

SEQ ID NO: 28905 - DNA, 24 bp, Homo sapiens
ttgcaaaaattggctgcttacaga

SEQ ID NO: 28906 - DNA, 24 bp, Homo sapiens
cttgcaaaaattggctgcttacag

SEQ ID NO: 28907 - DNA, 23 bp, Homo sapiens
cccttaccgtgccttccgtgtgg

SEQ ID NO: 28908 - DNA, 23 bp, Homo sapiens
aggcagtgacagcagcaggacta

SEQ ID NO: 28909 - DNA, 24 bp, Homo sapiens
ggcggagtccaacctataccttct

SEQ ID NO: 28910 - DNA, 24 bp, Homo sapiens
tttttatacagagtaccaagtatg

SEQ ID NO: 28911 - DNA, 24 bp, Homo sapiens
gtttttatacagagtaccaagtat

SEQ ID NO: 28912 - DNA, 24 bp, Homo sapiens
tgtttttatacagagtaccaagta

SEQ ID NO: 28913 - DNA, 24 bp, Homo sapiens
ttattataaaggtacatttgtcat

SEQ ID NO: 28914 - DNA, 24 bp, Homo sapiens
cttattataaaggtacatttgtca

SEQ ID NO: 28915 - DNA, 24 bp, Homo sapiens
tcttattataaaggtacatttgtc

SEQ ID NO: 28916 - DNA, 24 bp, Homo sapiens
agctgccgaccatattttccagca

SEQ ID NO: 28917 - DNA, 24 bp, Homo sapiens
aagctgccgaccatattttccagc

SEQ ID NO: 28918 - DNA, 24 bp, Homo sapiens
aaagctgccgaccatattttccag

SEQ ID NO: 28919 - DNA, 24 bp, Homo sapiens
ggtgaaggaccggatcctggagaa

SEQ ID NO: 28920 - DNA, 24 bp, Homo sapiens
tggcggtggcggcgacggtggcag

SEQ ID NO: 28921 - DNA, 24 bp, Homo sapiens
cccaggcgaggcgagggccgggcg

SEQ ID NO: 28922 - DNA, 24 bp, Homo sapiens
ggaggatcatttgagcccagaggt

SEQ ID NO: 28923 - DNA, 24 bp, Homo sapiens
ctgggctgggtaacagagtgagat

SEQ ID NO: 28924 - DNA, 25 bp, Homo sapiens
aggaggatctcagtcaagctgttgc

SEQ ID NO: 28925 - DNA, 24 bp, Homo sapiens
ctagaagcacatttttgtgatttt

SEQ ID NO: 28926 - DNA, 24 bp, Homo sapiens
tctagaagcacatttttgtgattt

SEQ ID NO: 28927 - DNA, 24 bp, Homo sapiens
ttctagaagcacatttttgtgatt

SEQ ID NO: 28928 - DNA, 24 bp, Homo sapiens
atggagaggtggtgctgacggcca

SEQ ID NO: 28929 - DNA, 24 bp, Homo sapiens
aatggagaggtggtgctgacggcc

SEQ ID NO: 28930 - DNA, 24 bp, Homo sapiens
gaatggagaggtggtgctgacggc

SEQ ID NO: 28931 - DNA, 24 bp, Homo sapiens
gaggatgtaaggtaataaattatt

SEQ ID NO: 28932 - DNA, 24 bp, Homo sapiens
tgaggatgtaaggtaataaattat

SEQ ID NO: 28933 - DNA, 24 bp, Homo sapiens
ctgaggatgtaaggtaataaatta

SEQ ID NO: 28934 - DNA, 25 bp, Homo sapiens
catcttcacatctgccaccacctcc

SEQ ID NO: 28935 - DNA, 25 bp, Homo sapiens
ttcccaaatacctgcccaaccatca

SEQ ID NO: 28936 - DNA, 25 bp, Homo sapiens
ggcaggtgctcagatggaagtagat

SEQ ID NO: 28937 - DNA, 24 bp, Homo sapiens
agtacaaaaaggtaaaagcaaagg

SEQ ID NO: 28938 - DNA, 24 bp, Homo sapiens
aagtacaaaaaggtaaaagcaaag

SEQ ID NO: 28939 - DNA, 24 bp, Homo sapiens
caagtacaaaaaggtaaaagcaaa

SEQ ID NO: 28940 - DNA, 24 bp, Homo sapiens
atgggaacaaggatggaagtttgc

SEQ ID NO: 28941 - DNA, 24 bp, Homo sapiens
aatgggaacaaggatggaagtttg

SEQ ID NO: 28942 - DNA, 24 bp, Homo sapiens
caatgggaacaaggatggaagttt

SEQ ID NO: 28943 - DNA, 25 bp, Homo sapiens
ggcaccttctcagatgtgaccttca

SEQ ID NO: 28944 - DNA, 24 bp, Homo sapiens
catgaaccaggagatcaccaaggc

SEQ ID NO: 28945 - DNA, 24 bp, Homo sapiens
ggctgatggtggtggtgaagatgg

SEQ ID NO: 28946 - DNA, 24 bp, Homo sapiens
cttaataccagaatggaatcttta

SEQ ID NO: 28947 - DNA, 24 bp, Homo sapiens
tcttaataccagaatggaatcttt

SEQ ID NO: 28948 - DNA, 24 bp, Homo sapiens
ctcttaataccagaatggaatctt

SEQ ID NO: 28949 - DNA, 24 bp, Homo sapiens
aaaaaatcaaggtataactatgga

SEQ ID NO: 28950 - DNA, 24 bp, Homo sapiens
caaaaaatcaaggtataactatgg

SEQ ID NO: 28951 - DNA, 24 bp, Homo sapiens
ccaaaaaatcaaggtataactatg

SEQ ID NO: 28952 - DNA, 24 bp, Homo sapiens
atataattaaggtcatacttgaaa

SEQ ID NO: 28953 - DNA, 24 bp, Homo sapiens
tatataattaaggtcatacttgaa

SEQ ID NO: 28954 - DNA, 24 bp, Homo sapiens
ttatataattaaggtcatacttga

SEQ ID NO: 28955 - DNA, 24 bp, Homo sapiens
ggtgtggtggcaggcacttgtaat

SEQ ID NO: 28956 - DNA, 23 bp, Homo sapiens
cctgggcgacagaatgagactcc

SEQ ID NO: 28957 - DNA, 25 bp, Homo sapiens
actttctatttcctgggctgtttgg

SEQ ID NO: 28958 - DNA, 24 bp, Homo sapiens
aacacctaagggaaaaaatcatta

SEQ ID NO: 28959 - DNA, 24 bp, Homo sapiens
caacacctaagggaaaaaatcatt

SEQ ID NO: 28960 - DNA, 24 bp, Homo sapiens
tcaacacctaagggaaaaaatcat

SEQ ID NO: 28961 - DNA, 24 bp, Homo sapiens
aacaactgcaggaactagagaata

SEQ ID NO: 28962 - DNA, 24 bp, Homo sapiens
caacaactgcaggaactagagaat

SEQ ID NO: 28963 - DNA, 24 bp, Homo sapiens
tcaacaactgcaggaactagagaa

SEQ ID NO: 28964 - DNA, 24 bp, Homo sapiens
agcagcaacagcaaccaggcatcc

SEQ ID NO: 28965 - DNA, 24 bp, Homo sapiens
cagcagcaacagcaaccaggcatc

SEQ ID NO: 28966 - DNA, 24 bp, Homo sapiens
ccagcagcaacagcaaccaggcat

SEQ ID NO: 28967 - DNA, 24 bp, Homo sapiens
cagcccccactatttcgctgcctc

SEQ ID NO: 28968 - DNA, 24 bp, Homo sapiens
acagcccccactatttcgctgcct

SEQ ID NO: 28969 - DNA, 24 bp, Homo sapiens
cacagcccccactatttcgctgcc

SEQ ID NO: 28970 - DNA, 24 bp, Homo sapiens
ctttgttacagatatgtttgctgt

SEQ ID NO: 28971 - DNA, 24 bp, Homo sapiens
tctttgttacagatatgtttgctg

SEQ ID NO: 28972 - DNA, 24 bp, Homo sapiens
ttctttgttacagatatgtttgct

SEQ ID NO: 28973 - DNA, 24 bp, Homo sapiens
aatcagtgagtgtaagtatatttc

SEQ ID NO: 28974 - DNA, 24 bp, Homo sapiens
gaatcagtgagtgtaagtatattt

SEQ ID NO: 28975 - DNA, 24 bp, Homo sapiens
tgaatcagtgagtgtaagtatatt

SEQ ID NO: 28976 - DNA, 24 bp, Homo sapiens
gggcagagttctttccgatccacg

SEQ ID NO: 28977 - DNA, 24 bp, Homo sapiens
gcagccagcagcgacacctcttct

SEQ ID NO: 28978 - DNA, 24 bp, Homo sapiens
cagcaacagggaccataggaaggc

SEQ ID NO: 28979 - DNA, 24 bp, Homo sapiens
aatctgaccagctctgggtgaacc

SEQ ID NO: 28980 - DNA, 24 bp, Homo sapiens
aaatctgaccagctctgggtgaac

SEQ ID NO: 28981 - DNA, 24 bp, Homo sapiens
gaaatctgaccagctctgggtgaa

SEQ ID NO: 28982 - DNA, 24 bp, Homo sapiens
attcattttaggtaaagaaagctg

SEQ ID NO: 28983 - DNA, 24 bp, Homo sapiens
tattcattttaggtaaagaaagct

SEQ ID NO: 28984 - DNA, 24 bp, Homo sapiens
ttattcattttaggtaaagaaagc

SEQ ID NO: 28985 - DNA, 24 bp, Homo sapiens
tactaaaaacatttgaagccttga

SEQ ID NO: 28986 - DNA, 24 bp, Homo sapiens
ttactaaaaacatttgaagccttg

SEQ ID NO: 28987 - DNA, 24 bp, Homo sapiens
tttactaaaaacatttgaagcctt

SEQ ID NO: 28988 - DNA, 24 bp, Homo sapiens
ttctttcccagataagaaatcatt

SEQ ID NO: 28989 - DNA, 24 bp, Homo sapiens
tttctttcccagataagaaatcat

SEQ ID NO: 28990 - DNA, 24 bp, Homo sapiens
ttttctttcccagataagaaatca

SEQ ID NO: 28991 - DNA, 24 bp, Homo sapiens
ggcattacaaggttagatgcatta

SEQ ID NO: 28992 - DNA, 24 bp, Homo sapiens
aggcattacaaggttagatgcatt

SEQ ID NO: 28993 - DNA, 24 bp, Homo sapiens
taggcattacaaggttagatgcat

SEQ ID NO: 28994 - DNA, 24 bp, Homo sapiens
tgacactaaagatgaaaaagaaag

SEQ ID NO: 28995 - DNA, 24 bp, Homo sapiens
ctgacactaaagatgaaaaagaaa

SEQ ID NO: 28996 - DNA, 24 bp, Homo sapiens
cctgacactaaagatgaaaaagaa

SEQ ID NO: 28997 - DNA, 24 bp, Homo sapiens
aattgattaagctttaaaactatc

SEQ ID NO: 28998 - DNA, 24 bp, Homo sapiens
caattgattaagctttaaaactat

SEQ ID NO: 28999 - DNA, 24 bp, Homo sapiens
acaattgattaagctttaaaacta

SEQ ID NO: 29000 - DNA, 24 bp, Homo sapiens
attctatattgatctcgatttatt

SEQ ID NO: 29001 - DNA, 24 bp, Homo sapiens
tattctatattgatctcgatttat

SEQ ID NO: 29002 - DNA, 24 bp, Homo sapiens
atattctatattgatctcgattta

SEQ ID NO: 29003 - DNA, 23 bp, Homo sapiens
gcggcagcagcagcagcaacccc

SEQ ID NO: 29004 - DNA, 23 bp, Homo sapiens
gggccgcagccatggtcccgagt

SEQ ID NO: 29005 - DNA, 23 bp, Homo sapiens
gtcccccagggcctcggcggccg

SEQ ID NO: 29006 - DNA, 24 bp, Homo sapiens
tgtccgacgaggccatactttgaa

SEQ ID NO: 29007 - DNA, 24 bp, Homo sapiens
gtgtccgacgaggccatactttga

SEQ ID NO: 29008 - DNA, 24 bp, Homo sapiens
agtgtccgacgaggccatactttg

SEQ ID NO: 29009 - DNA, 24 bp, Homo sapiens
ctctagatgttgtaagtattagtc

SEQ ID NO: 29010 - DNA, 24 bp, Homo sapiens
cctctagatgttgtaagtattagt

SEQ ID NO: 29011 - DNA, 24 bp, Homo sapiens
tcctctagatgttgtaagtattag

SEQ ID NO: 29012 - DNA, 24 bp, Homo sapiens
taacaggaaaggtattatttactt

SEQ ID NO: 29013 - DNA, 24 bp, Homo sapiens
ttaacaggaaaggtattatttact

SEQ ID NO: 29014 - DNA, 24 bp, Homo sapiens
gttaacaggaaaggtattatttac

SEQ ID NO: 29015 - DNA, 23 bp, Homo sapiens
ccgcagtcgccgccgcagcaaag

SEQ ID NO: 29016 - DNA, 23 bp, Homo sapiens
gggacgtcgggctcagaggcaga

SEQ ID NO: 29017 - DNA, 24 bp, Homo sapiens
aactcagctgacattctacacgga

SEQ ID NO: 29018 - DNA, 23 bp, Homo sapiens
tggctggagaatggcaccttgta

SEQ ID NO: 29019 - DNA, 25 bp, Homo sapiens
tcggagattgttgaggagcagatgc

SEQ ID NO: 29020 - DNA, 23 bp, Homo sapiens
ctgctgctgctgctggtgttcac

SEQ ID NO: 29021 - DNA, 25 bp, Homo sapiens
tcaatgacctgctgtcttccttcgg

SEQ ID NO: 29022 - DNA, 24 bp, Homo sapiens
tcgtgactgctctcggaacaatgg

SEQ ID NO: 29023 - DNA, 23 bp, Homo sapiens
aaggatggctctggctgctacga

SEQ ID NO: 29024 - DNA, 24 bp, Homo sapiens
gccctgtggcttcattttccagtt

SEQ ID NO: 29025 - DNA, 24 bp, Homo sapiens
tgccctgtggcttcattttccagt

SEQ ID NO: 29026 - DNA, 24 bp, Homo sapiens
atgccctgtggcttcattttccag

SEQ ID NO: 29027 - DNA, 24 bp, Homo sapiens
agaacagcctaagaacagcctcgc

SEQ ID NO: 29028 - DNA, 23 bp, Homo sapiens
cctcaagtcatcctcccgcctca

SEQ ID NO: 29029 - DNA, 24 bp, Homo sapiens
ctcactgtagcctcgacctcctgg

SEQ ID NO: 29030 - DNA, 23 bp, Homo sapiens
ctggaagtggtgggcaaggaggg

SEQ ID NO: 29031 - DNA, 25 bp, Homo sapiens
cctggacaagttaattgatggcacc

SEQ ID NO: 29032 - DNA, 23 bp, Homo sapiens
atgtggtcacgatccgcctggac

SEQ ID NO: 29033 - DNA, 23 bp, Homo sapiens
atgtgagcccaccgtgccctacc

SEQ ID NO: 29034 - DNA, 24 bp, Homo sapiens
cttgtgtacaatgggatcctggcc

SEQ ID NO: 29035 - DNA, 23 bp, Homo sapiens
agccacctggtggggggcatcct

SEQ ID NO: 29036 - DNA, 24 bp, Homo sapiens
atctatttcagagttccctaaaaa

SEQ ID NO: 29037 - DNA, 24 bp, Homo sapiens
gatctatttcagagttccctaaaa

SEQ ID NO: 29038 - DNA, 24 bp, Homo sapiens
ggatctatttcagagttccctaaa

SEQ ID NO: 29039 - DNA, 25 bp, Homo sapiens
cgtgctgagatggaagagatgagag

SEQ ID NO: 29040 - DNA, 23 bp, Homo sapiens
ggaacttcggcgagaactggacc

SEQ ID NO: 29041 - DNA, 23 bp, Homo sapiens
cctgaaagtggctgagacgggtc

SEQ ID NO: 29042 - DNA, 24 bp, Homo sapiens
ggggccgccaggtgagaccgcgtc

SEQ ID NO: 29043 - DNA, 24 bp, Homo sapiens
cggggccgccaggtgagaccgcgt

SEQ ID NO: 29044 - DNA, 24 bp, Homo sapiens
gcggggccgccaggtgagaccgcg

SEQ ID NO: 29045 - DNA, 25 bp, Homo sapiens
accaagaaagaagatattaaactat

SEQ ID NO: 29046 - DNA, 23 bp, Homo sapiens
gatcttcaggaaataggaattcc

SEQ ID NO: 29047 - DNA, 24 bp, Homo sapiens
actcctggtctcaagcaatcctcc

SEQ ID NO: 29048 - DNA, 24 bp, Homo sapiens
tgacggcattattaccaggagcat

SEQ ID NO: 29049 - DNA, 24 bp, Homo sapiens
tgagtgacaacattcagccaaact

SEQ ID NO: 29050 - DNA, 25 bp, Homo sapiens
aggaacttgaagacatacagcagca

SEQ ID NO: 29051 - DNA, 23 bp, Homo sapiens
cacacacgcacacacgcacacac

SEQ ID NO: 29052 - DNA, 25 bp, Homo sapiens
aactcaatcttctgttggatcacgg

SEQ ID NO: 29053 - DNA, 24 bp, Homo sapiens
attttaaatagcaaacagtttgtg

SEQ ID NO: 29054 - DNA, 24 bp, Homo sapiens
tattttaaatagcaaacagtttgt

SEQ ID NO: 29055 - DNA, 24 bp, Homo sapiens
ttattttaaatagcaaacagtttg

SEQ ID NO: 29056 - DNA, 24 bp, Homo sapiens
ggagggccaagagtgagatgagtg

SEQ ID NO: 29057 - DNA, 24 bp, Homo sapiens
cggagggccaagagtgagatgagt

SEQ ID NO: 29058 - DNA, 24 bp, Homo sapiens
ccggagggccaagagtgagatgag

SEQ ID NO: 29059 - DNA, 23 bp, Homo sapiens
cgaccagcaccagtccctcaaga

SEQ ID NO: 29060 - DNA, 23 bp, Homo sapiens
ttgtagagaagccagccagcacc

SEQ ID NO: 29061 - DNA, 25 bp, Homo sapiens
atgaaattcggaaagtgctgaccag

SEQ ID NO: 29062 - DNA, 23 bp, Homo sapiens
gcaccgacagcctggatgacttc

SEQ ID NO: 29063 - DNA, 23 bp, Homo sapiens
cctcctggactcgctgtctctgg

SEQ ID NO: 29064 - DNA, 23 bp, Homo sapiens
cagcggcgtgcctagtgagttgc

SEQ ID NO: 29065 - DNA, 23 bp, Homo sapiens
ggcgtggcagatcagggaacttc

SEQ ID NO: 29066 - DNA, 23 bp, Homo sapiens
gcaccgacagcctggatgacttc

SEQ ID NO: 29067 - DNA, 23 bp, Homo sapiens
cctcctggactcgctgtctctgg

SEQ ID NO: 29068 - DNA, 24 bp, Homo sapiens
acagaaaaagcgtaagtaattgca

SEQ ID NO: 29069 - DNA, 24 bp, Homo sapiens
aacagaaaaagcgtaagtaattgc

SEQ ID NO: 29070 - DNA, 24 bp, Homo sapiens
gaacagaaaaagcgtaagtaattg

SEQ ID NO: 29071 - DNA, 23 bp, Homo sapiens
gccctggactccctatcgtaccg

SEQ ID NO: 29072 - DNA, 25 bp, Homo sapiens
tgtggtgtatgatggtgctgtcttc

SEQ ID NO: 29073 - DNA, 25 bp, Homo sapiens
ggactagaattaagagtggcgaggc

SEQ ID NO: 29074 - DNA, 24 bp, Homo sapiens
acttaatcaaggtggcataaatct

SEQ ID NO: 29075 - DNA, 24 bp, Homo sapiens
cacttaatcaaggtggcataaatc

SEQ ID NO: 29076 - DNA, 24 bp, Homo sapiens
acacttaatcaaggtggcataaat

SEQ ID NO: 29077 - DNA, 25 bp, Homo sapiens
aatccaaccgagttagcagtcacct

SEQ ID NO: 29078 - DNA, 24 bp, Homo sapiens
gtctctctacctccagcacatccg

SEQ ID NO: 29079 - DNA, 24 bp, Homo sapiens
tgtgaaagtggtggctgctgtgag

SEQ ID NO: 29080 - DNA, 24 bp, Homo sapiens
agccgccaatacaagcatccagat

SEQ ID NO: 29081 - DNA, 24 bp, Homo sapiens
aacgcatcctggtgattggaatgg

SEQ ID NO: 29082 - DNA, 24 bp, Homo sapiens
ttatcagcaccaggcatggcacct

SEQ ID NO: 29083 - DNA, 24 bp, Homo sapiens
aggacgccaagatcagagtctgta

SEQ ID NO: 29084 - DNA, 24 bp, Homo sapiens
gaggacgccaagatcagagtctgt

SEQ ID NO: 29085 - DNA, 24 bp, Homo sapiens
agaggacgccaagatcagagtctg

SEQ ID NO: 29086 - DNA, 24 bp, Homo sapiens
ttcctatatagagtaattatttgg

SEQ ID NO: 29087 - DNA, 24 bp, Homo sapiens
tttcctatatagagtaattatttg

SEQ ID NO: 29088 - DNA, 24 bp, Homo sapiens
atttcctatatagagtaattattt

SEQ ID NO: 29089 - DNA, 24 bp, Homo sapiens
cagattagaggagtaattatttgg

SEQ ID NO: 29090 - DNA, 24 bp, Homo sapiens
tcagattagaggagtaattatttg

SEQ ID NO: 29091 - DNA, 24 bp, Homo sapiens
gtcagattagaggagtaattattt

SEQ ID NO: 29092 - DNA, 24 bp, Homo sapiens
cttctcaccaggggttcgtttccc

SEQ ID NO: 29093 - DNA, 24 bp, Homo sapiens
tcttctcaccaggggttcgtttcc

SEQ ID NO: 29094 - DNA, 24 bp, Homo sapiens
atcttctcaccaggggttcgtttc

SEQ ID NO: 29095 - DNA, 24 bp, Homo sapiens
agtgcagcagggtgtgtggccagg

SEQ ID NO: 29096 - DNA, 24 bp, Homo sapiens
aagtgcagcagggtgtgtggccag

SEQ ID NO: 29097 - DNA, 24 bp, Homo sapiens
aaagtgcagcagggtgtgtggcca

SEQ ID NO: 29098 - DNA, 24 bp, Homo sapiens
gcagcacgagaaggagggttacac

SEQ ID NO: 29099 - DNA, 24 bp, Homo sapiens
ggcgaggaccatgagaagaccaag

SEQ ID NO: 29100 - DNA, 24 bp, Homo sapiens
tccgagtacctcaagtgcctgacc

SEQ ID NO: 29101 - DNA, 23 bp, Homo sapiens
aacagggatagagccgaggagcc

SEQ ID NO: 29102 - DNA, 23 bp, Homo sapiens
ccaaggacccttctccgagcgtg

SEQ ID NO: 29103 - DNA, 23 bp, Homo sapiens
gagccagacggacagccagccag

SEQ ID NO: 29104 - DNA, 23 bp, Homo sapiens
ccgaccttcaagaagaacttcgc

SEQ ID NO: 29105 - DNA, 25 bp, Homo sapiens
cattccctagtggagctgctcaacc

SEQ ID NO: 29106 - DNA, 23 bp, Homo sapiens
caaccccaagcccgccagccccc

SEQ ID NO: 29107 - DNA, 23 bp, Homo sapiens
tcctcgcccgcctccactacatc

SEQ ID NO: 29108 - DNA, 25 bp, Homo sapiens
taacaacgtctacggagccatgcac

SEQ ID NO: 29109 - DNA, 23 bp, Homo sapiens
gagctcatcaatgaggccctgaa

SEQ ID NO: 29110 - DNA, 23 bp, Homo sapiens
cctgagtaaccagcagaaggcgg

SEQ ID NO: 29111 - DNA, 23 bp, Homo sapiens
ctcgcccgcctccactacatcat

SEQ ID NO: 29112 - DNA, 25 bp, Homo sapiens
taacaacgtctacggagccatgcac

SEQ ID NO: 29113 - DNA, 24 bp, Homo sapiens
tgtataggagtgtaagttggctaa

SEQ ID NO: 29114 - DNA, 24 bp, Homo sapiens
atgtataggagtgtaagttggcta

SEQ ID NO: 29115 - DNA, 24 bp, Homo sapiens
gatgtataggagtgtaagttggct

SEQ ID NO: 29116 - DNA, 23 bp, Homo sapiens
taagccaccgtgtccagcctgat

SEQ ID NO: 29117 - DNA, 23 bp, Homo sapiens
ataagccaggcggagtagcgtgt

SEQ ID NO: 29118 - DNA, 23 bp, Homo sapiens
caggaggctgaggtgggaggatc

SEQ ID NO: 29119 - DNA, 24 bp, Homo sapiens
gctcactacaacctccacctcctg

SEQ ID NO: 29120 - DNA, 23 bp, Homo sapiens
gcctcagcctcccgaatagttgg

SEQ ID NO: 29121 - DNA, 25 bp, Homo sapiens
gatgtgaatccttgggaaccagagg

SEQ ID NO: 29122 - DNA, 25 bp, Homo sapiens
tctccgccaattcaccttgactctg

SEQ ID NO: 29123 - DNA, 23 bp, Homo sapiens
ggcaggcacatcatggacaagtt

SEQ ID NO: 29124 - DNA, 25 bp, Homo sapiens
ggatgatgacaatgaggctactgga

SEQ ID NO: 29125 - DNA, 24 bp, Homo sapiens
tgcctgcgaacacattgctgtagt

SEQ ID NO: 29126 - DNA, 25 bp, Homo sapiens
catctggttctcgaactcctggacg

SEQ ID NO: 29127 - DNA, 25 bp, Homo sapiens
agtacagagagttccattggttcag

SEQ ID NO: 29128 - DNA, 25 bp, Homo sapiens
catctggttctcgaactcctggacg

SEQ ID NO: 29129 - DNA, 24 bp, Homo sapiens
tgcctgcgaacacattgctgtagt

SEQ ID NO: 29130 - DNA, 25 bp, Homo sapiens
tccattgtgtcctacagaagaaggt

SEQ ID NO: 29131 - DNA, 24 bp, Homo sapiens
aatccaagcagctgcatttgacaa

SEQ ID NO: 29132 - DNA, 24 bp, Homo sapiens
aaatccaagcagctgcatttgaca

SEQ ID NO: 29133 - DNA, 24 bp, Homo sapiens
aaaatccaagcagctgcatttgac

SEQ ID NO: 29134 - DNA, 24 bp, Homo sapiens
gctgaaggattacctggtggtggc

SEQ ID NO: 29135 - DNA, 23 bp, Homo sapiens
atctaccaggtgaagcagcagcg

SEQ ID NO: 29136 - DNA, 23 bp, Homo sapiens
gcacagcaggagtaccagcaact

SEQ ID NO: 29137 - DNA, 23 bp, Homo sapiens
ggagccatctggaagagtgcctg

SEQ ID NO: 29138 - DNA, 23 bp, Homo sapiens
acgctgtgtctgctctgttggaa

SEQ ID NO: 29139 - DNA, 23 bp, Homo sapiens
gagaagaggcaggagggcaggag

SEQ ID NO: 29140 - DNA, 23 bp, Homo sapiens
caggcactgcgagcaagactggc

SEQ ID NO: 29141 - DNA, 23 bp, Homo sapiens
tctgatgggagaagagacgccgc

SEQ ID NO: 29142 - DNA, 23 bp, Homo sapiens
ctgttctggatgaggcggctgtg

SEQ ID NO: 29143 - DNA, 24 bp, Homo sapiens
ttcctcataagaaaaaaaaggctg

SEQ ID NO: 29144 - DNA, 24 bp, Homo sapiens
gttcctcataagaaaaaaaaggct

SEQ ID NO: 29145 - DNA, 24 bp, Homo sapiens
agttcctcataagaaaaaaaaggc

SEQ ID NO: 29146 - DNA, 25 bp, Homo sapiens
gcagtgccaatatccgtccttaacc

SEQ ID NO: 29147 - DNA, 23 bp, Homo sapiens
ggaagcagaattggactgaagcc

SEQ ID NO: 29148 - DNA, 25 bp, Homo sapiens
aaggaacagttcaagaagagcaagc

SEQ ID NO: 29149 - DNA, 23 bp, Homo sapiens
agagaggggtgagccagcagttc

SEQ ID NO: 29150 - DNA, 24 bp, Homo sapiens
ccctccttcaagattgacttctcg

SEQ ID NO: 29151 - DNA, 23 bp, Homo sapiens
ctcgctacagtccgagaccgtcc

SEQ ID NO: 29152 - DNA, 24 bp, Homo sapiens
aaatagtccagcatcgattgttat

SEQ ID NO: 29153 - DNA, 24 bp, Homo sapiens
aaaatagtccagcatcgattgtta

SEQ ID NO: 29154 - DNA, 24 bp, Homo sapiens
aaaaatagtccagcatcgattgtt

SEQ ID NO: 29155 - DNA, 23 bp, Homo sapiens
cctgaggtggcatggtgatgtct

SEQ ID NO: 29156 - DNA, 23 bp, Homo sapiens
cccttcccactcatcctgtcacg

SEQ ID NO: 29157 - DNA, 25 bp, Homo sapiens
gaaacagggagaagacttatggacc

SEQ ID NO: 29158 - DNA, 25 bp, Homo sapiens
agtatgaagcaggctgacattggca

SEQ ID NO: 29159 - DNA, 25 bp, Homo sapiens
tgatgatgagaacagagtgaaccaa

SEQ ID NO: 29160 - DNA, 25 bp, Homo sapiens
gccagttcctctgaagagcttatca

SEQ ID NO: 29161 - DNA, 23 bp, Homo sapiens
agaggcaccaccacctgctcctg

SEQ ID NO: 29162 - DNA, 23 bp, Homo sapiens
ctgtcctcagcttctgggagcat

SEQ ID NO: 29163 - DNA, 23 bp, Homo sapiens
atgaaactcccttttaggaagac

SEQ ID NO: 29164 - DNA, 23 bp, Homo sapiens
ctcggagctgcgtcagttgcgtc

SEQ ID NO: 29165 - DNA, 23 bp, Homo sapiens
ctgctgctgggtgtggacatgct

SEQ ID NO: 29166 - DNA, 23 bp, Homo sapiens
ctgggcgtgggcttgctggacag

SEQ ID NO: 29167 - DNA, 24 bp, Homo sapiens
ttcctttgtagacatctggagaga

SEQ ID NO: 29168 - DNA, 24 bp, Homo sapiens
tttcctttgtagacatctggagag

SEQ ID NO: 29169 - DNA, 24 bp, Homo sapiens
atttcctttgtagacatctggaga

SEQ ID NO: 29170 - DNA, 24 bp, Homo sapiens
atttttaacaagtaagttttggct

SEQ ID NO: 29171 - DNA, 24 bp, Homo sapiens
tatttttaacaagtaagttttggc

SEQ ID NO: 29172 - DNA, 24 bp, Homo sapiens
atatttttaacaagtaagttttgg

SEQ ID NO: 29173 - DNA, 24 bp, Homo sapiens
taatggaagagatcaactgtatta

SEQ ID NO: 29174 - DNA, 24 bp, Homo sapiens
ataatggaagagatcaactgtatt

SEQ ID NO: 29175 - DNA, 24 bp, Homo sapiens
cataatggaagagatcaactgtat

SEQ ID NO: 29176 - DNA, 25 bp, Homo sapiens
agagcatgtggagaggaaggagact

SEQ ID NO: 29177 - DNA, 25 bp, Homo sapiens
catcaatacagcggacatcagcacc

SEQ ID NO: 29178 - DNA, 23 bp, Homo sapiens
atggtggtggtcccgctctatga

SEQ ID NO: 29179 - DNA, 23 bp, Homo sapiens
gctgaccttcttcctcgtgtcgg

SEQ ID NO: 29180 - DNA, 23 bp, Homo sapiens
ctactgctggggctgctgggctg

SEQ ID NO: 29181 - DNA, 23 bp, Homo sapiens
tgcggggctgcgggtcggggagg

SEQ ID NO: 29182 - DNA, 23 bp, Homo sapiens
ctgaccttcttcctcgtgtcggg

SEQ ID NO: 29183 - DNA, 23 bp, Homo sapiens
tgcggggctgcgggtcggggagg

SEQ ID NO: 29184 - DNA, 23 bp, Homo sapiens
ctactgctggggctgctgggctg

SEQ ID NO: 29185 - DNA, 24 bp, Homo sapiens
gatctatggaggtaaaaatataaa

SEQ ID NO: 29186 - DNA, 24 bp, Homo sapiens
ggatctatggaggtaaaaatataa

SEQ ID NO: 29187 - DNA, 24 bp, Homo sapiens
tggatctatggaggtaaaaatata

SEQ ID NO: 29188 - DNA, 24 bp, Homo sapiens
ttctgttctagtgtcttcatacag

SEQ ID NO: 29189 - DNA, 24 bp, Homo sapiens
tttctgttctagtgtcttcataca

SEQ ID NO: 29190 - DNA, 24 bp, Homo sapiens
ttttctgttctagtgtcttcatac

SEQ ID NO: 29191 - DNA, 24 bp, Homo sapiens
catagctacaggtaaaaaaaaatc

SEQ ID NO: 29192 - DNA, 24 bp, Homo sapiens
tcatagctacaggtaaaaaaaaat

SEQ ID NO: 29193 - DNA, 24 bp, Homo sapiens
tcatagctacaggtaaaaaaaaat

SEQ ID NO: 29194 - DNA, 23 bp, Homo sapiens
ggtggctcacgcctgtaatccct

SEQ ID NO: 29195 - DNA, 23 bp, Homo sapiens
agagcacccaggaccgggaccag

SEQ ID NO: 29196 - DNA, 25 bp, Homo sapiens
gctgcttcaaaattgaaagccaggc

SEQ ID NO: 29197 - DNA, 25 bp, Homo sapiens
tctggaactcctgacctcaagtgaa

SEQ ID NO: 29198 - DNA, 23 bp, Homo sapiens
gaaatccagcagcacgccaccat

SEQ ID NO: 29199 - DNA, 25 bp, Homo sapiens
gcactagcatcttctgtctctccct

SEQ ID NO: 29200 - DNA, 24 bp, Homo sapiens
ataaaagtcaggtacttcatagac

SEQ ID NO: 29201 - DNA, 24 bp, Homo sapiens
aataaaagtcaggtacttcataga

SEQ ID NO: 29202 - DNA, 24 bp, Homo sapiens
aaataaaagtcaggtacttcatag

SEQ ID NO: 29203 - DNA, 24 bp, Homo sapiens
gcggcagcgaggcagcatcacccc

SEQ ID NO: 29204 - DNA, 24 bp, Homo sapiens
tgcggcagcgaggcagcatcaccc

SEQ ID NO: 29205 - DNA, 24 bp, Homo sapiens
gtgcggcagcgaggcagcatcacc

SEQ ID NO: 29206 - DNA, 24 bp, Homo sapiens
attcccatgtggtaagttataatt

SEQ ID NO: 29207 - DNA, 24 bp, Homo sapiens
aattcccatgtggtaagttataat

SEQ ID NO: 29208 - DNA, 24 bp, Homo sapiens
taattcccatgtggtaagttataa

SEQ ID NO: 29209 - DNA, 24 bp, Homo sapiens
ttctattataggttaaatatgagt

SEQ ID NO: 29210 - DNA, 24 bp, Homo sapiens
cttctattataggttaaatatgag

SEQ ID NO: 29211 - DNA, 24 bp, Homo sapiens
tcttctattataggttaaatatga

SEQ ID NO: 29212 - DNA, 24 bp, Homo sapiens
ataatacgttggtaagtttatctt

SEQ ID NO: 29213 - DNA, 24 bp, Homo sapiens
tataatacgttggtaagtttatct

SEQ ID NO: 29214 - DNA, 24 bp, Homo sapiens
atataatacgttggtaagtttatc

SEQ ID NO: 29215 - DNA, 24 bp, Homo sapiens
tttatatgtagaaaaagcgtttac

SEQ ID NO: 29216 - DNA, 24 bp, Homo sapiens
ttttatatgtagaaaaagcgttta

SEQ ID NO: 29217 - DNA, 24 bp, Homo sapiens
tttttatatgtagaaaaagcgttt

SEQ ID NO: 29218 - DNA, 24 bp, Homo sapiens
tgtgggaacaaaggacagcatcgc

SEQ ID NO: 29219 - DNA, 24 bp, Homo sapiens
tgagcagttgcgacagattggagc

SEQ ID NO: 29220 - DNA, 24 bp, Homo sapiens
tgaccacagagacgaactcagtga

SEQ ID NO: 29221 - DNA, 24 bp, Homo sapiens
tgaaggcaccaacatcccaagtcc

SEQ ID NO: 29222 - DNA, 25 bp, Homo sapiens
agtatatgcctggaacggtacaaga

SEQ ID NO: 29223 - DNA, 23 bp, Homo sapiens
cagtgtgccgccagacctccatc

SEQ ID NO: 29224 - DNA, 25 bp, Homo sapiens
gtgtgctgcttatggaattggaggt

SEQ ID NO: 29225 - DNA, 24 bp, Homo sapiens
actcaaggatgtggtggaacagca

SEQ ID NO: 29226 - DNA, 24 bp, Homo sapiens
gtcctgtgagactgccatgtgtcg

SEQ ID NO: 29227 - DNA, 24 bp, Homo sapiens
atctattgcaggagaatgatatta

SEQ ID NO: 29228 - DNA, 24 bp, Homo sapiens
aatctattgcaggagaatgatatt

SEQ ID NO: 29229 - DNA, 24 bp, Homo sapiens
taatctattgcaggagaatgatat

SEQ ID NO: 29230 - DNA, 23 bp, Homo sapiens
gtgctgttcggagacctcgctgg

SEQ ID NO: 29231 - DNA, 23 bp, Homo sapiens
agtgctctggcttctgctgggat

SEQ ID NO: 29232 - DNA, 24 bp, Homo sapiens
gctacaacctcacgctgaacgaca

SEQ ID NO: 29233 - DNA, 24 bp, Homo sapiens
ttttaaatgaggtaacatcatatt

SEQ ID NO: 29234 - DNA, 24 bp, Homo sapiens
attttaaatgaggtaacatcatat

SEQ ID NO: 29235 - DNA, 24 bp, Homo sapiens
aattttaaatgaggtaacatcata

SEQ ID NO: 29236 - DNA, 24 bp, Homo sapiens
taaaatatgaggctgaaactaaat

SEQ ID NO: 29237 - DNA, 24 bp, Homo sapiens
ttaaaatatgaggctgaaactaaa

SEQ ID NO: 29238 - DNA, 24 bp, Homo sapiens
attaaaatatgaggctgaaactaa

SEQ ID NO: 29239 - DNA, 24 bp, Homo sapiens
gtcctcgcctccctcgccgccgcc

SEQ ID NO: 29240 - DNA, 24 bp, Homo sapiens
cgtcggggttacgccgccgggctg

SEQ ID NO: 29241 - DNA, 24 bp, Homo sapiens
gcgcgggccttgccccatggtgtc

SEQ ID NO: 29242 - DNA, 24 bp, Homo sapiens
taccaggcagttggcaggcagttc

SEQ ID NO: 29243 - DNA, 24 bp, Homo sapiens
gggttggccctcactatcagcggg

SEQ ID NO: 29244 - DNA, 24 bp, Homo sapiens
acaggaggcgccccagcttgcggc

SEQ ID NO: 29245 - DNA, 24 bp, Homo sapiens
tgtaattacagacatatcaagtgg

SEQ ID NO: 29246 - DNA, 24 bp, Homo sapiens
ttgtaattacagacatatcaagtg

SEQ ID NO: 29247 - DNA, 24 bp, Homo sapiens
tttgtaattacagacatatcaagt

SEQ ID NO: 29248 - DNA, 24 bp, Homo sapiens
cctggaaaacggcaagactcggaa

SEQ ID NO: 29249 - DNA, 24 bp, Homo sapiens
acctggaaaacggcaagactcgga

SEQ ID NO: 29250 - DNA, 24 bp, Homo sapiens
aacctggaaaacggcaagactcgg

SEQ ID NO: 29251 - DNA, 24 bp, Homo sapiens
aagacgctaatgaactgaagacga

SEQ ID NO: 29252 - DNA, 24 bp, Homo sapiens
gtacagaattggcatccagtcggc

SEQ ID NO: 29253 - DNA, 24 bp, Homo sapiens
gtgatattgtgactgcctgcttgc

SEQ ID NO: 29254 - DNA, 25 bp, Homo sapiens
gacgatgatgccaacagtgatgcct

SEQ ID NO: 29255 - DNA, 24 bp, Homo sapiens
atatggctccaggaatggtggcat

SEQ ID NO: 29256 - DNA, 23 bp, Homo sapiens
gcggcagactgaggatgtagcag

SEQ ID NO: 29257 - DNA, 24 bp, Homo sapiens
cctttccacctgccctgctctcta

SEQ ID NO: 29258 - DNA, 24 bp, Homo sapiens
gatatgctgggaagaacgatggct

SEQ ID NO: 29259 - DNA, 24 bp, Homo sapiens
gggacagggaaatctctccgaggg

SEQ ID NO: 29260 - DNA, 23 bp, Homo sapiens
gaaggagcaagcagtcggcagca

SEQ ID NO: 29261 - DNA, 25 bp, Homo sapiens
aactctcaagcctctcatctctgcc

SEQ ID NO: 29262 - DNA, 25 bp, Homo sapiens
ctaccttctcagatgtccagcgtct

SEQ ID NO: 29263 - DNA, 23 bp, Homo sapiens
attgagcaggcaggcaggaagga

SEQ ID NO: 29264 - DNA, 25 bp, Homo sapiens
cgtcatatcacctggagtcacatca

SEQ ID NO: 29265 - DNA, 23 bp, Homo sapiens
cgcagactatcaccacggctcct

SEQ ID NO: 29266 - DNA, 24 bp, Homo sapiens
ttcctgagggttttgcaagatacc

SEQ ID NO: 29267 - DNA, 24 bp, Homo sapiens
attcctgagggttttgcaagatac

SEQ ID NO: 29268 - DNA, 24 bp, Homo sapiens
aattcctgagggttttgcaagata

SEQ ID NO: 29269 - DNA, 24 bp, Homo sapiens
tttcatatcagtcactatgaacaa

SEQ ID NO: 29270 - DNA, 24 bp, Homo sapiens
ttttcatatcagtcactatgaaca

SEQ ID NO: 29271 - DNA, 24 bp, Homo sapiens
cttttcatatcagtcactatgaac

SEQ ID NO: 29272 - DNA, 24 bp, Homo sapiens
gtaagcacaagccaatagaagttg

SEQ ID NO: 29273 - DNA, 24 bp, Homo sapiens
cgtaagcacaagccaatagaagtt

SEQ ID NO: 29274 - DNA, 24 bp, Homo sapiens
acgtaagcacaagccaatagaagt

SEQ ID NO: 29275 - DNA, 24 bp, Homo sapiens
tcttactttagcgactctaatgat

SEQ ID NO: 29276 - DNA, 24 bp, Homo sapiens
ttcttactttagcgactctaatga

SEQ ID NO: 29277 - DNA, 24 bp, Homo sapiens
tttcttactttagcgactctaatg

SEQ ID NO: 29278 - DNA, 23 bp, Homo sapiens
agaagcagcaacagcagcgagag

SEQ ID NO: 29279 - DNA, 25 bp, Homo sapiens
cctacctcatcaagatcacctccga

SEQ ID NO: 29280 - DNA, 25 bp, Homo sapiens
cgagcctgtgtggaaagaagtcatt

SEQ ID NO: 29281 - DNA, 24 bp, Homo sapiens
aagaatttgaggtaaattgactgt

SEQ ID NO: 29282 - DNA, 24 bp, Homo sapiens
aaagaatttgaggtaaattgactg

SEQ ID NO: 29283 - DNA, 24 bp, Homo sapiens
taaagaatttgaggtaaattgact

SEQ ID NO: 29284 - DNA, 24 bp, Homo sapiens
aaaaacatcagagtatggtaaaga

SEQ ID NO: 29285 - DNA, 24 bp, Homo sapiens
caaaaacatcagagtatggtaaag

SEQ ID NO: 29286 - DNA, 24 bp, Homo sapiens
acaaaaacatcagagtatggtaaa

SEQ ID NO: 29287 - DNA, 24 bp, Homo sapiens
cgttgtaaaagttattaaatgaag

SEQ ID NO: 29288 - DNA, 24 bp, Homo sapiens
tcgttgtaaaagttattaaatgaa

SEQ ID NO: 29289 - DNA, 24 bp, Homo sapiens
ttcgttgtaaaagttattaaatga

SEQ ID NO: 29290 - DNA, 24 bp, Homo sapiens
tttaaatttagggataaagtaatt

SEQ ID NO: 29291 - DNA, 24 bp, Homo sapiens
ttttaaatttagggataaagtaat

SEQ ID NO: 29292 - DNA, 24 bp, Homo sapiens
cttttaaatttagggataaagtaa

SEQ ID NO: 29293 - DNA, 24 bp, Homo sapiens
atagaaaagaggttgttaaaatta

SEQ ID NO: 29294 - DNA, 24 bp, Homo sapiens
tatagaaaagaggttgttaaaatt

SEQ ID NO: 29295 - DNA, 24 bp, Homo sapiens
ttatagaaaagaggttgttaaaat

SEQ ID NO: 29296 - DNA, 24 bp, Homo sapiens
cctgctacagtcggtcaatcagtt

SEQ ID NO: 29297 - DNA, 23 bp, Homo sapiens
catggacataatcctctcatgaa

SEQ ID NO: 29298 - DNA, 24 bp, Homo sapiens
ttttgatgtctacctgtgttttct

SEQ ID NO: 29299 - DNA, 24 bp, Homo sapiens
acatcagtctgaaacggctttaaa

SEQ ID NO: 29300 - DNA, 25 bp, Homo sapiens
tgtcatcgtccagaagaagactcag

SEQ ID NO: 29301 - DNA, 24 bp, Homo sapiens
acgactgtttacgggagatgctgc

SEQ ID NO: 29302 - DNA, 23 bp, Homo sapiens
cgaaggcggaagaggaagcacag

SEQ ID NO: 29303 - DNA, 24 bp, Homo sapiens
cagcagcagcagcaagagtcagga

SEQ ID NO: 29304 - DNA, 24 bp, Homo sapiens
gtcctctacatcctggctgctcgc

SEQ ID NO: 29305 - DNA, 24 bp, Homo sapiens
cactgccagcgtcttaacttgtca

SEQ ID NO: 29306 - DNA, 23 bp, Homo sapiens
tctaccagtgccactctgacagg

SEQ ID NO: 29307 - DNA, 25 bp, Homo sapiens
cacctacaacatcatagtggaggca

SEQ ID NO: 29308 - DNA, 24 bp, Homo sapiens
gaccagcagaggcataaggttcgg

SEQ ID NO: 29309 - DNA, 23 bp, Homo sapiens
ggaggagaggcaccacgagaagt

SEQ ID NO: 29310 - DNA, 24 bp, Homo sapiens
cgtctacaccatccaagtcctgag

SEQ ID NO: 29311 - DNA, 23 bp, Homo sapiens
agactcaggaagcatcgttgtgt

SEQ ID NO: 29312 - DNA, 24 bp, Homo sapiens
aaaactttaaggtacgtttattgt

SEQ ID NO: 29313 - DNA, 24 bp, Homo sapiens
gaaaactttaaggtacgtttattg

SEQ ID NO: 29314 - DNA, 24 bp, Homo sapiens
tgaaaactttaaggtacgtttatt

SEQ ID NO: 29315 - DNA, 24 bp, Homo sapiens
tgtttctaaagtcaagaagaagaa

SEQ ID NO: 29316 - DNA, 24 bp, Homo sapiens
ttgtttctaaagtcaagaagaaga

SEQ ID NO: 29317 - DNA, 24 bp, Homo sapiens
cttgtttctaaagtcaagaagaag

SEQ ID NO: 29318 - DNA, 24 bp, Homo sapiens
taaagaaaaaggtaatgttgaaaa

SEQ ID NO: 29319 - DNA, 24 bp, Homo sapiens
ttaaagaaaaaggtaatgttgaaa

SEQ ID NO: 29320 - DNA, 24 bp, Homo sapiens
attaaagaaaaaggtaatgttgaa

SEQ ID NO: 29321 - DNA, 24 bp, Homo sapiens
attttcaacagaattcaagaggaa

SEQ ID NO: 29322 - DNA, 24 bp, Homo sapiens
tattttcaacagaattcaagagga

SEQ ID NO: 29323 - DNA, 24 bp, Homo sapiens
atattttcaacagaattcaagagg

SEQ ID NO: 29324 - DNA, 24 bp, Homo sapiens
ttgattctgtggtactaggaattt

SEQ ID NO: 29325 - DNA, 24 bp, Homo sapiens
cttgattctgtggtactaggaatt

SEQ ID NO: 29326 - DNA, 24 bp, Homo sapiens
acttgattctgtggtactaggaat

SEQ ID NO: 29327 - DNA, 24 bp, Homo sapiens
tgcatggaaagcatgtgatgatct

SEQ ID NO: 29328 - DNA, 24 bp, Homo sapiens
atgcatggaaagcatgtgatgatc

SEQ ID NO: 29329 - DNA, 24 bp, Homo sapiens
aatgcatggaaagcatgtgatgat

SEQ ID NO: 29330 - DNA, 24 bp, Homo sapiens
tttcctcctagatatgatgaagat

SEQ ID NO: 29331 - DNA, 24 bp, Homo sapiens
ctttcctcctagatatgatgaaga

SEQ ID NO: 29332 - DNA, 24 bp, Homo sapiens
tctttcctcctagatatgatgaag

SEQ ID NO: 29333 - DNA, 25 bp, Homo sapiens
tgctgctgctgacggattctatctc

SEQ ID NO: 29334 - DNA, 25 bp, Homo sapiens
tggctgtgaacattaagactcctgt

SEQ ID NO: 29335 - DNA, 24 bp, Homo sapiens
caggctcaactgtggctcaagaga

SEQ ID NO: 29336 - DNA, 23 bp, Homo sapiens
tagccaccattcccagccgcaag

SEQ ID NO: 29337 - DNA, 23 bp, Homo sapiens
tggacctgcttaccagttacctg

SEQ ID NO: 29338 - DNA, 23 bp, Homo sapiens
ggctaccctgagtaccgatctgc

SEQ ID NO: 29339 - DNA, 24 bp, Homo sapiens
tatgcgctcagttccagctattct

SEQ ID NO: 29340 - DNA, 24 bp, Homo sapiens
gtatgcgctcagttccagctattc

SEQ ID NO: 29341 - DNA, 24 bp, Homo sapiens
cgtatgcgctcagttccagctatt

SEQ ID NO: 29342 - DNA, 24 bp, Homo sapiens
tctttatttagattgatgacaagg

SEQ ID NO: 29343 - DNA, 24 bp, Homo sapiens
ttctttatttagattgatgacaag

SEQ ID NO: 29344 - DNA, 24 bp, Homo sapiens
tttctttatttagattgatgacaa

SEQ ID NO: 29345 - DNA, 24 bp, Homo sapiens
aacactaacagatgaacaagttgt

SEQ ID NO: 29346 - DNA, 24 bp, Homo sapiens
aaacactaacagatgaacaagttg

SEQ ID NO: 29347 - DNA, 24 bp, Homo sapiens
aaaacactaacagatgaacaagtt

SEQ ID NO: 29348 - DNA, 24 bp, Homo sapiens
aacactaacaggtatttattttct

SEQ ID NO: 29349 - DNA, 24 bp, Homo sapiens
aaacactaacaggtatttattttc

SEQ ID NO: 29350 - DNA, 24 bp, Homo sapiens
aaaacactaacaggtatttatttt

SEQ ID NO: 29351 - DNA, 24 bp, Homo sapiens
taatgttagaggtaacactttact

SEQ ID NO: 29352 - DNA, 24 bp, Homo sapiens
ataatgttagaggtaacactttac

SEQ ID NO: 29353 - DNA, 24 bp, Homo sapiens
aataatgttagaggtaacacttta

SEQ ID NO: 29354 - DNA, 24 bp, Homo sapiens
ttaaaaaccagacttttgaagatt

SEQ ID NO: 29355 - DNA, 24 bp, Homo sapiens
gttaaaaaccagacttttgaagat

SEQ ID NO: 29356 - DNA, 24 bp, Homo sapiens
ggttaaaaaccagacttttgaaga

SEQ ID NO: 29357 - DNA, 24 bp, Homo sapiens
atttcattaaggttattgaagatc

SEQ ID NO: 29358 - DNA, 24 bp, Homo sapiens
catttcattaaggttattgaagat

SEQ ID NO: 29359 - DNA, 24 bp, Homo sapiens
gcatttcattaaggttattgaaga

SEQ ID NO: 29360 - DNA, 24 bp, Homo sapiens
ggcggctggagaggcaaacaggaa

SEQ ID NO: 29361 - DNA, 24 bp, Homo sapiens
tggcggctggagaggcaaacagga

SEQ ID NO: 29362 - DNA, 24 bp, Homo sapiens
ctggcggctggagaggcaaacagg

SEQ ID NO: 29363 - DNA, 24 bp, Homo sapiens
cgacctgaggaccaaggcacttac

SEQ ID NO: 29364 - DNA, 24 bp, Homo sapiens
ggcggtgctggaggtgactgtgtc

SEQ ID NO: 29365 - DNA, 24 bp, Homo sapiens
ctggctctactggaagtggaggca

SEQ ID NO: 29366 - DNA, 24 bp, Homo sapiens
cgacctgaggaccaaggcacttac

SEQ ID NO: 29367 - DNA, 24 bp, Homo sapiens
cccacccacagcctggtcatccat

SEQ ID NO: 29368 - DNA, 24 bp, Homo sapiens
ggcggtgctggaggtgactgtgtc

SEQ ID NO: 29369 - DNA, 24 bp, Homo sapiens
gaaaagactgtaggagataatgat

SEQ ID NO: 29370 - DNA, 24 bp, Homo sapiens
tgaaaagactgtaggagataatga

SEQ ID NO: 29371 - DNA, 24 bp, Homo sapiens
ctgaaaagactgtaggagataatg

SEQ ID NO: 29372 - DNA, 24 bp, Homo sapiens
agtcagtgtcgtctatcaatatta

SEQ ID NO: 29373 - DNA, 24 bp, Homo sapiens
cagtcagtgtcgtctatcaatatt

SEQ ID NO: 29374 - DNA, 24 bp, Homo sapiens
acagtcagtgtcgtctatcaatat

SEQ ID NO: 29375 - DNA, 23 bp, Homo sapiens
gcggtggctcatgcctgtaatcc

SEQ ID NO: 29376 - DNA, 25 bp, Homo sapiens
tggtggttccagttaagactgttaa

SEQ ID NO: 29377 - DNA, 25 bp, Homo sapiens
tctggaaggagagttcgatctggtg

SEQ ID NO: 29378 - DNA, 23 bp, Homo sapiens
gaagaagcccaactcggagcgga

SEQ ID NO: 29379 - DNA, 23 bp, Homo sapiens
ctcctgccacctccacgaacaag

SEQ ID NO: 29380 - DNA, 24 bp, Homo sapiens
cgccgcaggtggtggaggcgccag

SEQ ID NO: 29381 - DNA, 24 bp, Homo sapiens
tcgccgcaggtggtggaggcgcca

SEQ ID NO: 29382 - DNA, 24 bp, Homo sapiens
atcgccgcaggtggtggaggcgcc

SEQ ID NO: 29383 - DNA, 24 bp, Homo sapiens
acttgatcaaggtaaaaacaattt

SEQ ID NO: 29384 - DNA, 24 bp, Homo sapiens
aacttgatcaaggtaaaaacaatt

SEQ ID NO: 29385 - DNA, 24 bp, Homo sapiens
aaacttgatcaaggtaaaaacaat

SEQ ID NO: 29386 - DNA, 23 bp, Homo sapiens
tccgagggcttctctctcaaggc

SEQ ID NO: 29387 - DNA, 23 bp, Homo sapiens
caccactcagcgccaaggaggac

SEQ ID NO: 29388 - DNA, 23 bp, Homo sapiens
gcccccagctccctcgccactgc

SEQ ID NO: 29389 - DNA, 24 bp, Homo sapiens
ccacctcgccagtctccaatcaag

SEQ ID NO: 29390 - DNA, 23 bp, Homo sapiens
ctcccagcagccaccgccgcagc

SEQ ID NO: 29391 - DNA, 23 bp, Homo sapiens
ctgccctacgccttcttcaccca

SEQ ID NO: 29392 - DNA, 24 bp, Homo sapiens
gctattacccggtaagtatatttt

SEQ ID NO: 29393 - DNA, 24 bp, Homo sapiens
tgctattacccggtaagtatattt

SEQ ID NO: 29394 - DNA, 24 bp, Homo sapiens
gtgctattacccggtaagtatatt

SEQ ID NO: 29395 - DNA, 24 bp, Homo sapiens
cctcctcaacacctgtcacctctg

SEQ ID NO: 29396 - DNA, 24 bp, Homo sapiens
gtgaccaactcttacagccgccag

SEQ ID NO: 29397 - DNA, 24 bp, Homo sapiens
aaacaggatttggaggtggcagga

SEQ ID NO: 29398 - DNA, 24 bp, Homo sapiens
gccccatgcaggcagccctgcagg

SEQ ID NO: 29399 - DNA, 24 bp, Homo sapiens
ggccccatgcaggcagccctgcag

SEQ ID NO: 29400 - DNA, 24 bp, Homo sapiens
aggccccatgcaggcagccctgca

SEQ ID NO: 29401 - DNA, 24 bp, Homo sapiens
tctcatttcagatgtaaagacatt

SEQ ID NO: 29402 - DNA, 24 bp, Homo sapiens
ttctcatttcagatgtaaagacat

SEQ ID NO: 29403 - DNA, 24 bp, Homo sapiens
cttctcatttcagatgtaaagaca

SEQ ID NO: 29404 - DNA, 24 bp, Homo sapiens
gatcttttcagatacagttaaaaa

SEQ ID NO: 29405 - DNA, 24 bp, Homo sapiens
tgatcttttcagatacagttaaaa

SEQ ID NO: 29406 - DNA, 24 bp, Homo sapiens
gtgatcttttcagatacagttaaa

SEQ ID NO: 29407 - DNA, 23 bp, Homo sapiens
cgggctcaagcgatcctctcact

SEQ ID NO: 29408 - DNA, 24 bp, Homo sapiens
ttcccaataactaggactacaggc

SEQ ID NO: 29409 - DNA, 23 bp, Homo sapiens
gatcacagctcagtgcagctttg

SEQ ID NO: 29410 - DNA, 24 bp, Homo sapiens
acttaataaagacgtgaagaagtt

SEQ ID NO: 29411 - DNA, 24 bp, Homo sapiens
tacttaataaagacgtgaagaagt

SEQ ID NO: 29412 - DNA, 24 bp, Homo sapiens
gtacttaataaagacgtgaagaag

SEQ ID NO: 29413 - DNA, 24 bp, Homo sapiens
tcatctctcaggctggagtgcaat

SEQ ID NO: 29414 - DNA, 24 bp, Homo sapiens
gtcatctctcaggctggagtgcaa

SEQ ID NO: 29415 - DNA, 24 bp, Homo sapiens
cgtcatctctcaggctggagtgca

SEQ ID NO: 29416 - DNA, 24 bp, Homo sapiens
tcccggcccagcactgccagccac

SEQ ID NO: 29417 - DNA, 24 bp, Homo sapiens
ctcccggcccagcactgccagcca

SEQ ID NO: 29418 - DNA, 24 bp, Homo sapiens
cctcccggcccagcactgccagcc

SEQ ID NO: 29419 - DNA, 24 bp, Homo sapiens
caactgacgagggacactgtggaa

SEQ ID NO: 29420 - DNA, 24 bp, Homo sapiens
gcaactgacgagggacactgtgga

SEQ ID NO: 29421 - DNA, 24 bp, Homo sapiens
agcaactgacgagggacactgtgg

SEQ ID NO: 29422 - DNA, 23 bp, Homo sapiens
cagagcctcgccgcctgcctgtg

SEQ ID NO: 29423 - DNA, 23 bp, Homo sapiens
gccacctgccatgccctcagccg

SEQ ID NO: 29424 - DNA, 23 bp, Homo sapiens
gacggcttagacgtgatgggggt

SEQ ID NO: 29425 - DNA, 24 bp, Homo sapiens
tggctggctgaccactactactgg

SEQ ID NO: 29426 - DNA, 24 bp, Homo sapiens
tcctccatctccatctgcctgtcg

SEQ ID NO: 29427 - DNA, 25 bp, Homo sapiens
aagcaaagccagactctaagggaca

SEQ ID NO: 29428 - DNA, 23 bp, Homo sapiens
gcatgagtgtggtggtggcgtgg

SEQ ID NO: 29429 - DNA, 23 bp, Homo sapiens
cggtgccagtcagcgtcctccac

SEQ ID NO: 29430 - DNA, 24 bp, Homo sapiens
acccaggtcttggcagtgatgaga

SEQ ID NO: 29431 - DNA, 24 bp, Homo sapiens
cgctgaggaacatcactgacaccg

SEQ ID NO: 29432 - DNA, 23 bp, Homo sapiens
ctgctgctgctgggtctggtcac

SEQ ID NO: 29433 - DNA, 23 bp, Homo sapiens
gagagcgtgctagaccagtgcct

SEQ ID NO: 29434 - DNA, 24 bp, Homo sapiens
ggttcaagcgattctcctgcctca

SEQ ID NO: 29435 - DNA, 23 bp, Homo sapiens
agatggagtctcgctctgtcgcc

SEQ ID NO: 29436 - DNA, 24 bp, Homo sapiens
aggcaggctggcgatttcattcat

SEQ ID NO: 29437 - DNA, 24 bp, Homo sapiens
aaattatgaaggtaagttttagac

SEQ ID NO: 29438 - DNA, 24 bp, Homo sapiens
gaaattatgaaggtaagttttaga

SEQ ID NO: 29439 - DNA, 24 bp, Homo sapiens
agaaattatgaaggtaagttttag

SEQ ID NO: 29440 - DNA, 24 bp, Homo sapiens
ttcttttacagtaaatggaaatgt

SEQ ID NO: 29441 - DNA, 24 bp, Homo sapiens
attcttttacagtaaatggaaatg

SEQ ID NO: 29442 - DNA, 24 bp, Homo sapiens
aattcttttacagtaaatggaaat

SEQ ID NO: 29443 - DNA, 24 bp, Homo sapiens
aataactaaaggtatgtattaagc

SEQ ID NO: 29444 - DNA, 24 bp, Homo sapiens
aaataactaaaggtatgtattaag

SEQ ID NO: 29445 - DNA, 24 bp, Homo sapiens
gaaataactaaaggtatgtattaa

SEQ ID NO: 29446 - DNA, 23 bp, Homo sapiens
ttgaacgggtcgaggccggggga

SEQ ID NO: 29447 - DNA, 23 bp, Homo sapiens
aacatggcgttctggggttggcg

SEQ ID NO: 29448 - DNA, 23 bp, Homo sapiens
aggcctgcggctgtcggctggtg

SEQ ID NO: 29449 - DNA, 24 bp, Homo sapiens
tttttaatcaggtaatttgttgcc

SEQ ID NO: 29450 - DNA, 24 bp, Homo sapiens
atttttaatcaggtaatttgttgc

SEQ ID NO: 29451 - DNA, 24 bp, Homo sapiens
tatttttaatcaggtaatttgttg

SEQ ID NO: 29452 - DNA, 24 bp, Homo sapiens
gctggagctggatgcctgggaacc

SEQ ID NO: 29453 - DNA, 24 bp, Homo sapiens
ggctggagctggatgcctgggaac

SEQ ID NO: 29454 - DNA, 24 bp, Homo sapiens
aggctggagctggatgcctgggaa

SEQ ID NO: 29455 - DNA, 25 bp, Homo sapiens
ccatcagaggaaacagacatcatct

SEQ ID NO: 29456 - DNA, 25 bp, Homo sapiens
gccgcttgaagatgccattgaagat

SEQ ID NO: 29457 - DNA, 23 bp, Homo sapiens
cagcagccgccgccgagatgtcc

SEQ ID NO: 29458 - DNA, 24 bp, Homo sapiens
tctctcattaggtattgcaaatgc

SEQ ID NO: 29459 - DNA, 24 bp, Homo sapiens
ttctctcattaggtattgcaaatg

SEQ ID NO: 29460 - DNA, 24 bp, Homo sapiens
cttctctcattaggtattgcaaat

SEQ ID NO: 29461 - DNA, 24 bp, Homo sapiens
cttccttccagattccgttctatc

SEQ ID NO: 29462 - DNA, 24 bp, Homo sapiens
tcttccttccagattccgttctat

SEQ ID NO: 29463 - DNA, 24 bp, Homo sapiens
ctcttccttccagattccgttcta

SEQ ID NO: 29464 - DNA, 24 bp, Homo sapiens
tgagaaaaaagtgttaaaagatca

SEQ ID NO: 29465 - DNA, 24 bp, Homo sapiens
ttgagaaaaaagtgttaaaagatc

SEQ ID NO: 29466 - DNA, 24 bp, Homo sapiens
tttgagaaaaaagtgttaaaagat

SEQ ID NO: 29467 - DNA, 24 bp, Homo sapiens
tccattgcaagcacatgacctctg

SEQ ID NO: 29468 - DNA, 24 bp, Homo sapiens
ttccattgcaagcacatgacctct

SEQ ID NO: 29469 - DNA, 24 bp, Homo sapiens
cttccattgcaagcacatgacctc

SEQ ID NO: 29470 - DNA, 24 bp, Homo sapiens
tggaactcaaggtatgtctttact

SEQ ID NO: 29471 - DNA, 24 bp, Homo sapiens
atggaactcaaggtatgtctttac

SEQ ID NO: 29472 - DNA, 24 bp, Homo sapiens
tatggaactcaaggtatgtcttta

SEQ ID NO: 29473 - DNA, 24 bp, Homo sapiens
aatcacgagcaaggtcacactgga

SEQ ID NO: 29474 - DNA, 24 bp, Homo sapiens
acagattggagacagagtgatggc

SEQ ID NO: 29475 - DNA, 24 bp, Homo sapiens
attggctgggcaggttgttcacac

SEQ ID NO: 29476 - DNA, 24 bp, Homo sapiens
gctttggtgtcttcatccttctct

SEQ ID NO: 29477 - DNA, 24 bp, Homo sapiens
tccatgagtgcatacagcctgagt

SEQ ID NO: 29478 - DNA, 24 bp, Homo sapiens
ctacctcgaagcctctactccacc

SEQ ID NO: 29479 - DNA, 24 bp, Homo sapiens
tgtcacatatgctattttgtttga

SEQ ID NO: 29480 - DNA, 24 bp, Homo sapiens
atgtcacatatgctattttgtttg

SEQ ID NO: 29481 - DNA, 24 bp, Homo sapiens
aatgtcacatatgctattttgttt

SEQ ID NO: 29482 - DNA, 24 bp, Homo sapiens
caacattctaagagaattcatctg

SEQ ID NO: 29483 - DNA, 24 bp, Homo sapiens
tcaacattctaagagaattcatct

SEQ ID NO: 29484 - DNA, 24 bp, Homo sapiens
ttcaacattctaagagaattcatc

SEQ ID NO: 29485 - DNA, 24 bp, Homo sapiens
gatgatcaaagctattttgtttga

SEQ ID NO: 29486 - DNA, 24 bp, Homo sapiens
agatgatcaaagctattttgtttg

SEQ ID NO: 29487 - DNA, 24 bp, Homo sapiens
aagatgatcaaagctattttgttt

SEQ ID NO: 29488 - DNA, 24 bp, Homo sapiens
ctgtccaacttcctgctgtccgtg

SEQ ID NO: 29489 - DNA, 24 bp, Homo sapiens
caattctcctgcctcagcctcctg

SEQ ID NO: 29490 - DNA, 24 bp, Homo sapiens
acctggtcatcgtggtcaccttgt

SEQ ID NO: 29491 - DNA, 24 bp, Homo sapiens
tggaatccgtgaggaccaggtctt

SEQ ID NO: 29492 - DNA, 24 bp, Homo sapiens
cagggcaaagggtgtggggagaag

SEQ ID NO: 29493 - DNA, 24 bp, Homo sapiens
ccctggggccaagagactccacgt

SEQ ID NO: 29494 - DNA, 24 bp, Homo sapiens
caattctcctgcctcagcctcctg

SEQ ID NO: 29495 - DNA, 24 bp, Homo sapiens
gcactgaccatgagcctcaactcc

SEQ ID NO: 29496 - DNA, 24 bp, Homo sapiens
cagatggcgcgatctcggctcctg

SEQ ID NO: 29497 - DNA, 24 bp, Homo sapiens
caagcaattctcctgcctcagcct

SEQ ID NO: 29498 - DNA, 24 bp, Homo sapiens
tggaatccgtgaggaccaggtctt

SEQ ID NO: 29499 - DNA, 24 bp, Homo sapiens
caccctgttgcttaggcagatggc

SEQ ID NO: 29500 - DNA, 24 bp, Homo sapiens
caagcaattctcctgcctcagcct

SEQ ID NO: 29501 - DNA, 24 bp, Homo sapiens
caccctgttgcttaggcagatggc

SEQ ID NO: 29502 - DNA, 24 bp, Homo sapiens
tatggtcaccaagcctggaaacat

SEQ ID NO: 29503 - DNA, 24 bp, Homo sapiens
caagcaattctcctgcctcagcct

SEQ ID NO: 29504 - DNA, 24 bp, Homo sapiens
caccctgttgcttaggcagatggc

SEQ ID NO: 29505 - DNA, 24 bp, Homo sapiens
gctcaatatggtcaccaagcctgg

SEQ ID NO: 29506 - DNA, 23 bp, Homo sapiens
caggaagcccacggtgttcactc

SEQ ID NO: 29507 - DNA, 23 bp, Homo sapiens
cagaggatggtggctggcaggtc

SEQ ID NO: 29508 - DNA, 25 bp, Homo sapiens
gtgaccagctttgtttctgcctttg

SEQ ID NO: 29509 - DNA, 24 bp, Homo sapiens
caaagacagcaaatgtagtctaag

SEQ ID NO: 29510 - DNA, 24 bp, Homo sapiens
acaaagacagcaaatgtagtctaa

SEQ ID NO: 29511 - DNA, 24 bp, Homo sapiens
tacaaagacagcaaatgtagtcta

SEQ ID NO: 29512 - DNA, 24 bp, Homo sapiens
tattcagcttggtttctttggaag

SEQ ID NO: 29513 - DNA, 24 bp, Homo sapiens
atattcagcttggtttctttggaa

SEQ ID NO: 29514 - DNA, 24 bp, Homo sapiens
aatattcagcttggtttctttgga

SEQ ID NO: 29515 - DNA, 25 bp, Homo sapiens
ggttctaacaatgcgttattccaga

SEQ ID NO: 29516 - DNA, 25 bp, Homo sapiens
tctatcttctacagcagtggttgtt

SEQ ID NO: 29517 - DNA, 25 bp, Homo sapiens
aatgtagtctaagagcactgaatcg

SEQ ID NO: 29518 - DNA, 24 bp, Homo sapiens
ttttattataggaaaaattgatgg

SEQ ID NO: 29519 - DNA, 24 bp, Homo sapiens
gttttattataggaaaaattgatg

SEQ ID NO: 29520 - DNA, 24 bp, Homo sapiens
tgttttattataggaaaaattgat

SEQ ID NO: 29521 - DNA, 24 bp, Homo sapiens
ccctgcttctggaactattagtct

SEQ ID NO: 29522 - DNA, 24 bp, Homo sapiens
accctgcttctggaactattagtc

SEQ ID NO: 29523 - DNA, 24 bp, Homo sapiens
aaccctgcttctggaactattagt

SEQ ID NO: 29524 - DNA, 24 bp, Homo sapiens
tctcctctcaggaagggctgctgt

SEQ ID NO: 29525 - DNA, 24 bp, Homo sapiens
ttctcctctcaggaagggctgctg

SEQ ID NO: 29526 - DNA, 24 bp, Homo sapiens
gttctcctctcaggaagggctgct

SEQ ID NO: 29527 - DNA, 24 bp, Homo sapiens
agattgccccagcctggcctcgcc

SEQ ID NO: 29528 - DNA, 24 bp, Homo sapiens
cagattgccccagcctggcctcgc

SEQ ID NO: 29529 - DNA, 24 bp, Homo sapiens
tcagattgccccagcctggcctcg

SEQ ID NO: 29530 - DNA, 23 bp, Homo sapiens
gtggaaggcggtggtggtgactt

SEQ ID NO: 29531 - DNA, 23 bp, Homo sapiens
tgagtgtggacatctgcgtgacc

SEQ ID NO: 29532 - DNA, 25 bp, Homo sapiens
tctatgtcttcagccacctggaccg

SEQ ID NO: 29533 - DNA, 24 bp, Homo sapiens
agacgacaaggttccaacgctcac

SEQ ID NO: 29534 - DNA, 23 bp, Homo sapiens
gctcggcattatcatagtggcag

SEQ ID NO: 29535 - DNA, 24 bp, Homo sapiens
gaagccatcaccgaagccctcatc

SEQ ID NO: 29536 - DNA, 25 bp, Homo sapiens
accacatttagcaggaacagaacaa

SEQ ID NO: 29537 - DNA, 24 bp, Homo sapiens
gcaaagcaaattcaatcccagtgg

SEQ ID NO: 29538 - DNA, 25 bp, Homo sapiens
atgatgtcctgttgtcctacccaaa

SEQ ID NO: 29539 - DNA, 25 bp, Homo sapiens
tcagaggagcagtggaaccagacag

SEQ ID NO: 29540 - DNA, 25 bp, Homo sapiens
gtattgaccctcagagtggagcagc

SEQ ID NO: 29541 - DNA, 25 bp, Homo sapiens
tggtcttcttggttctactgagtgg

SEQ ID NO: 29542 - DNA, 24 bp, Homo sapiens
agcattgaaaggtaaagaaaaaca

SEQ ID NO: 29543 - DNA, 24 bp, Homo sapiens
aagcattgaaaggtaaagaaaaac

SEQ ID NO: 29544 - DNA, 24 bp, Homo sapiens
gaagcattgaaaggtaaagaaaaa

SEQ ID NO: 29545 - DNA, 24 bp, Homo sapiens
caataacacaggtgaaaagaaaaa

SEQ ID NO: 29546 - DNA, 24 bp, Homo sapiens
tcaataacacaggtgaaaagaaaa

SEQ ID NO: 29547 - DNA, 24 bp, Homo sapiens
atcaataacacaggtgaaaagaaa

SEQ ID NO: 29548 - DNA, 24 bp, Homo sapiens
cactggagaaggtattcttagagc

SEQ ID NO: 29549 - DNA, 24 bp, Homo sapiens
acactggagaaggtattcttagag

SEQ ID NO: 29550 - DNA, 24 bp, Homo sapiens
cacactggagaaggtattcttaga

SEQ ID NO: 29551 - DNA, 24 bp, Homo sapiens
ggtcaaatcacggcaatcctgggt

SEQ ID NO: 29552 - DNA, 25 bp, Homo sapiens
ccaacagaaggatcagttaccatct

SEQ ID NO: 29553 - DNA, 25 bp, Homo sapiens
actggcgtctgtcctcaattcaatg

SEQ ID NO: 29554 - DNA, 24 bp, Homo sapiens
gtcataagtcggtaaaataattgt

SEQ ID NO: 29555 - DNA, 24 bp, Homo sapiens
agtcataagtcggtaaaataattg

SEQ ID NO: 29556 - DNA, 24 bp, Homo sapiens
aagtcataagtcggtaaaataatt

SEQ ID NO: 29557 - DNA, 24 bp, Homo sapiens
aattacttcagatgtatcggaaca

SEQ ID NO: 29558 - DNA, 24 bp, Homo sapiens
aaattacttcagatgtatcggaac

SEQ ID NO: 29559 - DNA, 24 bp, Homo sapiens
aaaattacttcagatgtatcggaa

SEQ ID NO: 29560 - DNA, 23 bp, Homo sapiens
tgcgatctcggctcactggaacc

SEQ ID NO: 29561 - DNA, 24 bp, Homo sapiens
gattttcaagattgttggtcttga

SEQ ID NO: 29562 - DNA, 24 bp, Homo sapiens
agattttcaagattgttggtcttg

SEQ ID NO: 29563 - DNA, 24 bp, Homo sapiens
cagattttcaagattgttggtctt

SEQ ID NO: 29564 - DNA, 25 bp, Homo sapiens
gccatccttctcagtgcgaacttga

SEQ ID NO: 29565 - DNA, 24 bp, Homo sapiens
ggaacggtggctcatgcctgtaat

SEQ ID NO: 29566 - DNA, 23 bp, Homo sapiens
aacactgcgtccagcatttgggt

SEQ ID NO: 29567 - DNA, 25 bp, Homo sapiens
gtcaccctcccagcaacagaagaac

SEQ ID NO: 29568 - DNA, 25 bp, Homo sapiens
ttaacaggcgaatgcacttctccaa

SEQ ID NO: 29569 - DNA, 25 bp, Homo sapiens
gaatctggtcagcttagtgcgttct

SEQ ID NO: 29570 - DNA, 23 bp, Homo sapiens
tggctccgagaggactgcccagg

SEQ ID NO: 29571 - DNA, 23 bp, Homo sapiens
ctgctgctgccgcccgtcaccct

SEQ ID NO: 29572 - DNA, 24 bp, Homo sapiens
tgcaagtcaccatggacgctgaag

SEQ ID NO: 29573 - DNA, 23 bp, Homo sapiens
ccacctgccccacccctcacctc

SEQ ID NO: 29574 - DNA, 23 bp, Homo sapiens
ccccccaagtgctgctggaggat

SEQ ID NO: 29575 - DNA, 23 bp, Homo sapiens
atgcagctgtacctgcagcagct

SEQ ID NO: 29576 - DNA, 24 bp, Homo sapiens
tttaaatgcagaattccagaagat

SEQ ID NO: 29577 - DNA, 24 bp, Homo sapiens
ttttaaatgcagaattccagaaga

SEQ ID NO: 29578 - DNA, 24 bp, Homo sapiens
tttttaaatgcagaattccagaag

SEQ ID NO: 29579 - DNA, 24 bp, Homo sapiens
gtcttgataaggaatttgatgaat

SEQ ID NO: 29580 - DNA, 24 bp, Homo sapiens
agtcttgataaggaatttgatgaa

SEQ ID NO: 29581 - DNA, 24 bp, Homo sapiens
cagtcttgataaggaatttgatga

SEQ ID NO: 29582 - DNA, 24 bp, Homo sapiens
tctttaaacagagtctactagatg

SEQ ID NO: 29583 - DNA, 24 bp, Homo sapiens
ttctttaaacagagtctactagat

SEQ ID NO: 29584 - DNA, 24 bp, Homo sapiens
cttctttaaacagagtctactaga

SEQ ID NO: 29585 - DNA, 24 bp, Homo sapiens
ggatgcagaagatgtggatgtgcc

SEQ ID NO: 29586 - DNA, 24 bp, Homo sapiens
tggatgcagaagatgtggatgtgc

SEQ ID NO: 29587 - DNA, 24 bp, Homo sapiens
ctggatgcagaagatgtggatgtg

SEQ ID NO: 29588 - DNA, 23 bp, Homo sapiens
gtgataccagcaatagttcttcc

SEQ ID NO: 29589 - DNA, 23 bp, Homo sapiens
ccatcatcaggtagcaagttgaa

SEQ ID NO: 29590 - DNA, 23 bp, Homo sapiens
ccatgccatcttctccagccacc

SEQ ID NO: 29591 - DNA, 23 bp, Homo sapiens
cctgggcttcctgtgctgcttcg

SEQ ID NO: 29592 - DNA, 25 bp, Homo sapiens
gctggtggatgaattggatctcact

SEQ ID NO: 29593 - DNA, 24 bp, Homo sapiens
accgagaggctatgtttgcactgc

SEQ ID NO: 29594 - DNA, 23 bp, Homo sapiens
cctgggcttcctgtgctgcttcg

SEQ ID NO: 29595 - DNA, 25 bp, Homo sapiens
gctggtggatgaattggatctcact

SEQ ID NO: 29596 - DNA, 24 bp, Homo sapiens
gcagcaagaagaaggagcaggagg

SEQ ID NO: 29597 - DNA, 24 bp, Homo sapiens
ctttgtgacagctacatcagcaag

SEQ ID NO: 29598 - DNA, 24 bp, Homo sapiens
tctttgtgacagctacatcagcaa

SEQ ID NO: 29599 - DNA, 24 bp, Homo sapiens
ctctttgtgacagctacatcagca

SEQ ID NO: 29600 - DNA, 25 bp, Homo sapiens
cgccaagatgatgttcgtcaaagcc

SEQ ID NO: 29601 - DNA, 24 bp, Homo sapiens
ttagttgctgctgcctatcgccac

SEQ ID NO: 29602 - DNA, 24 bp, Homo sapiens
gcagtaaccaggctaaggaaccag

SEQ ID NO: 29603 - DNA, 24 bp, Homo sapiens
gattttattatgtaagtttttgaa

SEQ ID NO: 29604 - DNA, 24 bp, Homo sapiens
ggattttattatgtaagtttttga

SEQ ID NO: 29605 - DNA, 24 bp, Homo sapiens
tggattttattatgtaagtttttg

SEQ ID NO: 29606 - DNA, 25 bp, Homo sapiens
gccttgtgccctcaaacttcttgga

SEQ ID NO: 29607 - DNA, 25 bp, Homo sapiens
cactactctcaagatacgccaatgc

SEQ ID NO: 29608 - DNA, 25 bp, Homo sapiens
ttacagtttttggtgaaattgatga

SEQ ID NO: 29609 - DNA, 24 bp, Homo sapiens
aagaacacaagatctaccaaaagt

SEQ ID NO: 29610 - DNA, 24 bp, Homo sapiens
taagaacacaagatctaccaaaag

SEQ ID NO: 29611 - DNA, 24 bp, Homo sapiens
ctaagaacacaagatctaccaaaa

SEQ ID NO: 29612 - DNA, 24 bp, Homo sapiens
gttttagatggttatttgggattt

SEQ ID NO: 29613 - DNA, 24 bp, Homo sapiens
agttttagatggttatttgggatt

SEQ ID NO: 29614 - DNA, 24 bp, Homo sapiens
aagttttagatggttatttgggat

SEQ ID NO: 29615 - DNA, 24 bp, Homo sapiens
ataatcatattgtaagtattttat

SEQ ID NO: 29616 - DNA, 24 bp, Homo sapiens
tataatcatattgtaagtatttta

SEQ ID NO: 29617 - DNA, 24 bp, Homo sapiens
atataatcatattgtaagtatttt

SEQ ID NO: 29618 - DNA, 24 bp, Homo sapiens
aaaccattacacaaattgaagagt

SEQ ID NO: 29619 - DNA, 24 bp, Homo sapiens
aaaaccattacacaaattgaagag

SEQ ID NO: 29620 - DNA, 24 bp, Homo sapiens
aaaaaccattacacaaattgaaga

SEQ ID NO: 29621 - DNA, 24 bp, Homo sapiens
agctgcccaagccttttttccggc

SEQ ID NO: 29622 - DNA, 24 bp, Homo sapiens
gagctgcccaagccttttttccgg

SEQ ID NO: 29623 - DNA, 24 bp, Homo sapiens
cgagctgcccaagccttttttccg

SEQ ID NO: 29624 - DNA, 24 bp, Homo sapiens
gggttcaagcgattctcctgcctc

SEQ ID NO: 29625 - DNA, 24 bp, Homo sapiens
cgcaatcttggctcgccgcaactg

SEQ ID NO: 29626 - DNA, 24 bp, Homo sapiens
agcaccctcttcttctgttcagga

SEQ ID NO: 29627 - DNA, 24 bp, Homo sapiens
ttattttaaagcaacaaggaaaaa

SEQ ID NO: 29628 - DNA, 24 bp, Homo sapiens
tttattttaaagcaacaaggaaaa

SEQ ID NO: 29629 - DNA, 24 bp, Homo sapiens
ctttattttaaagcaacaaggaaa

SEQ ID NO: 29630 - DNA, 24 bp, Homo sapiens
gaagatatacaaaattgtgaggtt

SEQ ID NO: 29631 - DNA, 24 bp, Homo sapiens
tgaagatatacaaaattgtgaggt

SEQ ID NO: 29632 - DNA, 24 bp, Homo sapiens
ttgaagatatacaaaattgtgagg

SEQ ID NO: 29633 - DNA, 23 bp, Homo sapiens
gtgtctacgcggacgcaccggct

SEQ ID NO: 29634 - DNA, 23 bp, Homo sapiens
cggtgaggctgcgcggggccgag

SEQ ID NO: 29635 - DNA, 23 bp, Homo sapiens
cttctgccgccgccggccgcctg

SEQ ID NO: 29636 - DNA, 25 bp, Homo sapiens
cagccacttctctgccaactggatt

SEQ ID NO: 29637 - DNA, 23 bp, Homo sapiens
ttctgcctgctgctgctacctgg

SEQ ID NO: 29638 - DNA, 25 bp, Homo sapiens
catcggtgcttccttcactgtgtca

SEQ ID NO: 29639 - DNA, 25 bp, Homo sapiens
tactggctgaaaggtgtccgctact

SEQ ID NO: 29640 - DNA, 25 bp, Homo sapiens
catcggtgcttccttcactgtgtca

SEQ ID NO: 29641 - DNA, 23 bp, Homo sapiens
ttctgcctgctgctgctacctgg

SEQ ID NO: 29642 - DNA, 24 bp, Homo sapiens
cagatatttagagttaataaagat

SEQ ID NO: 29643 - DNA, 24 bp, Homo sapiens
ccagatatttagagttaataaaga

SEQ ID NO: 29644 - DNA, 24 bp, Homo sapiens
gccagatatttagagttaataaag

SEQ ID NO: 29645 - DNA, 24 bp, Homo sapiens
gaatatgcaagattaccaaagctt

SEQ ID NO: 29646 - DNA, 24 bp, Homo sapiens
ggaatatgcaagattaccaaagct

SEQ ID NO: 29647 - DNA, 24 bp, Homo sapiens
aggaatatgcaagattaccaaagc

SEQ ID NO: 29648 - DNA, 24 bp, Homo sapiens
ctgcagccaggaggggaaactgag

SEQ ID NO: 29649 - DNA, 24 bp, Homo sapiens
cctgcagccaggaggggaaactga

SEQ ID NO: 29650 - DNA, 24 bp, Homo sapiens
acctgcagccaggaggggaaactg

SEQ ID NO: 29651 - DNA, 23 bp, Homo sapiens
gcagcagtatcccgtggcaacaa

SEQ ID NO: 29652 - DNA, 23 bp, Homo sapiens
ttcttcaacggcatctggcggat

SEQ ID NO: 29653 - DNA, 23 bp, Homo sapiens
ctccatcgtgctgctgctcaagg

SEQ ID NO: 29654 - DNA, 23 bp, Homo sapiens
ctgtcgggtgctgcctcctggac

SEQ ID NO: 29655 - DNA, 23 bp, Homo sapiens
gacatctcccatctgctggcgga

SEQ ID NO: 29656 - DNA, 23 bp, Homo sapiens
caccagcctgagccgccacgcca

SEQ ID NO: 29657 - DNA, 24 bp, Homo sapiens
aaaaatttaaggataatccgactg

SEQ ID NO: 29658 - DNA, 24 bp, Homo sapiens
aaaaaatttaaggataatccgact

SEQ ID NO: 29659 - DNA, 24 bp, Homo sapiens
gaaaaaatttaaggataatccgac

SEQ ID NO: 29660 - DNA, 23 bp, Homo sapiens
aggcggaggcaggatgaagatga

SEQ ID NO: 29661 - DNA, 23 bp, Homo sapiens
ccgtagccgtctgcgtcccagcg

SEQ ID NO: 29662 - DNA, 23 bp, Homo sapiens
gcagctccgcgcaacgctagtcg

SEQ ID NO: 29663 - DNA, 24 bp, Homo sapiens
tttgttaaagaattaatgttcttc

SEQ ID NO: 29664 - DNA, 24 bp, Homo sapiens
ctttgttaaagaattaatgttctt

SEQ ID NO: 29665 - DNA, 24 bp, Homo sapiens
actttgttaaagaattaatgttct

SEQ ID NO: 29666 - DNA, 24 bp, Homo sapiens
gcagcagcagcaatgagccttcct

SEQ ID NO: 29667 - DNA, 24 bp, Homo sapiens
cgtcttccttcgtcttcacctacc

SEQ ID NO: 29668 - DNA, 24 bp, Homo sapiens
tccgtgccagacatggacctatct

SEQ ID NO: 29669 - DNA, 23 bp, Homo sapiens
accaggttccaagagtcacaatt

SEQ ID NO: 29670 - DNA, 25 bp, Homo sapiens
agtgctggcttctgatttggtggtc

SEQ ID NO: 29671 - DNA, 23 bp, Homo sapiens
atgttgtcgtggaatcgggtgcg

SEQ ID NO: 29672 - DNA, 24 bp, Homo sapiens
caagtcactaggaatgtctttttt

SEQ ID NO: 29673 - DNA, 24 bp, Homo sapiens
gcaagtcactaggaatgtcttttt

SEQ ID NO: 29674 - DNA, 24 bp, Homo sapiens
agcaagtcactaggaatgtctttt

SEQ ID NO: 29675 - DNA, 24 bp, Homo sapiens
ttgtaacgcagatacagcaatgat

SEQ ID NO: 29676 - DNA, 24 bp, Homo sapiens
attgtaacgcagatacagcaatga

SEQ ID NO: 29677 - DNA, 24 bp, Homo sapiens
tattgtaacgcagatacagcaatg

SEQ ID NO: 29678 - DNA, 24 bp, Homo sapiens
cgaggacgagtctgtgctccatca

SEQ ID NO: 29679 - DNA, 23 bp, Homo sapiens
tcggcgatctgagccccaggcag

SEQ ID NO: 29680 - DNA, 23 bp, Homo sapiens
cccgccgcctcccgcccccaaac

SEQ ID NO: 29681 - DNA, 25 bp, Homo sapiens
aagaacgagcctctgactccaggtt

SEQ ID NO: 29682 - DNA, 25 bp, Homo sapiens
acaccttacagtgaggcagaatggc

SEQ ID NO: 29683 - DNA, 23 bp, Homo sapiens
gcagtggtgttatctcggctcac

SEQ ID NO: 29684 - DNA, 25 bp, Homo sapiens
aaacacaaatgggagccaattctgc

SEQ ID NO: 29685 - DNA, 23 bp, Homo sapiens
gcacctgcactttgagaggctgt

SEQ ID NO: 29686 - DNA, 23 bp, Homo sapiens
acgattgaagctccagagggcca

SEQ ID NO: 29687 - DNA, 25 bp, Homo sapiens
cgaagccgtgcagtttctgagaagg

SEQ ID NO: 29688 - DNA, 23 bp, Homo sapiens
cagcaccctggctcccacctccc

SEQ ID NO: 29689 - DNA, 23 bp, Homo sapiens
cccaaaagcctccaggagctggc

SEQ ID NO: 29690 - DNA, 24 bp, Homo sapiens
ttattttctaggcaattcgaagtt

SEQ ID NO: 29691 - DNA, 24 bp, Homo sapiens
cttattttctaggcaattcgaagt

SEQ ID NO: 29692 - DNA, 24 bp, Homo sapiens
ccttattttctaggcaattcgaag

SEQ ID NO: 29693 - DNA, 25 bp, Homo sapiens
gctataatgacaacacttggggagg

SEQ ID NO: 29694 - DNA, 25 bp, Homo sapiens
gattgcttgaggccaggagtttgag

SEQ ID NO: 29695 - DNA, 23 bp, Homo sapiens
aaacaagggtcctggccaaccac

SEQ ID NO: 29696 - DNA, 23 bp, Homo sapiens
atggtggtgctgggtgcctctcg

SEQ ID NO: 29697 - DNA, 24 bp, Homo sapiens
atcgtgtctcgcttcctcaatggc

SEQ ID NO: 29698 - DNA, 24 bp, Homo sapiens
ccaccatcgaggacttccaccgta

SEQ ID NO: 29699 - DNA, 24 bp, Homo sapiens
tgatacagacctggcagtgatggc

SEQ ID NO: 29700 - DNA, 24 bp, Homo sapiens
caggctggagtgtagtggtgtgat

SEQ ID NO: 29701 - DNA, 24 bp, Homo sapiens
tgacctcaagtgatctgcctgcct

SEQ ID NO: 29702 - DNA, 24 bp, Homo sapiens
aaacctggaagagattcaccaaca

SEQ ID NO: 29703 - DNA, 24 bp, Homo sapiens
taaacctggaagagattcaccaac

SEQ ID NO: 29704 - DNA, 24 bp, Homo sapiens
ataaacctggaagagattcaccaa

SEQ ID NO: 29705 - DNA, 24 bp, Homo sapiens
ggctgtaggtggaggtatggctcg

SEQ ID NO: 29706 - DNA, 23 bp, Homo sapiens
tggcggtagaggaggctgtggtc

SEQ ID NO: 29707 - DNA, 23 bp, Homo sapiens
catggcggtggcagcagaggtgg

SEQ ID NO: 29708 - DNA, 25 bp, Homo sapiens
gccaaccattgatccgaataccagg

SEQ ID NO: 29709 - DNA, 23 bp, Homo sapiens
caacaaggtgacgagagcagacg

SEQ ID NO: 29710 - DNA, 25 bp, Homo sapiens
cctatgcgttcacaaccaagtctct

SEQ ID NO: 29711 - DNA, 24 bp, Homo sapiens
ggatcttcagaaaattggaagaat

SEQ ID NO: 29712 - DNA, 24 bp, Homo sapiens
tggatcttcagaaaattggaagaa

SEQ ID NO: 29713 - DNA, 24 bp, Homo sapiens
ttggatcttcagaaaattggaaga

SEQ ID NO: 29714 - DNA, 23 bp, Homo sapiens
caatcctcaagcaactggtgtcc

SEQ ID NO: 29715 - DNA, 24 bp, Homo sapiens
tctgcccactggacttggacttca

SEQ ID NO: 29716 - DNA, 24 bp, Homo sapiens
ggaccgagccttatgatctcctca

SEQ ID NO: 29717 - DNA, 24 bp, Homo sapiens
cttcggctcaatgctgagctgagc

SEQ ID NO: 29718 - DNA, 24 bp, Homo sapiens
gcttcggctcaatgctgagctgag

SEQ ID NO: 29719 - DNA, 24 bp, Homo sapiens
agcttcggctcaatgctgagctga

SEQ ID NO: 29720 - DNA, 24 bp, Homo sapiens
gtgcctgagtgggctggccgtgga

SEQ ID NO: 29721 - DNA, 24 bp, Homo sapiens
tgtgcctgagtgggctggccgtgg

SEQ ID NO: 29722 - DNA, 24 bp, Homo sapiens
ctgtgcctgagtgggctggccgtg

SEQ ID NO: 29723 - DNA, 24 bp, Homo sapiens
tgtagagaaaggtataaaagatgt

SEQ ID NO: 29724 - DNA, 24 bp, Homo sapiens
ttgtagagaaaggtataaaagatg

SEQ ID NO: 29725 - DNA, 24 bp, Homo sapiens
attgtagagaaaggtataaaagat

SEQ ID NO: 29726 - DNA, 24 bp, Homo sapiens
gttgtaaagcactaatagatgatg

SEQ ID NO: 29727 - DNA, 24 bp, Homo sapiens
agttgtaaagcactaatagatgat

SEQ ID NO: 29728 - DNA, 24 bp, Homo sapiens
cagttgtaaagcactaatagatga

SEQ ID NO: 29729 - DNA, 24 bp, Homo sapiens
gcattggcatgatctcggctgact

SEQ ID NO: 29730 - DNA, 23 bp, Homo sapiens
cagccactagggaagccagagcc

SEQ ID NO: 29731 - DNA, 24 bp, Homo sapiens
gcagacggagtctcactctgttgc

SEQ ID NO: 29732 - DNA, 24 bp, Homo sapiens
aaaacaaaaaaattgagaggctgg

SEQ ID NO: 29733 - DNA, 24 bp, Homo sapiens
aaaaacaaaaaaattgagaggctg

SEQ ID NO: 29734 - DNA, 24 bp, Homo sapiens
aaaaaacaaaaaaattgagaggct

SEQ ID NO: 29735 - DNA, 24 bp, Homo sapiens
tatgtggaaagattcttcaaactt

SEQ ID NO: 29736 - DNA, 24 bp, Homo sapiens
ttatgtggaaagattcttcaaact

SEQ ID NO: 29737 - DNA, 24 bp, Homo sapiens
cttatgtggaaagattcttcaaac

SEQ ID NO: 29738 - DNA, 24 bp, Homo sapiens
aaccagaaaagctaaagaatattg

SEQ ID NO: 29739 - DNA, 24 bp, Homo sapiens
aaaccagaaaagctaaagaatatt

SEQ ID NO: 29740 - DNA, 24 bp, Homo sapiens
aaaaccagaaaagctaaagaatat

SEQ ID NO: 29741 - DNA, 23 bp, Homo sapiens
aacagaacaggaggtggtagagg

SEQ ID NO: 29742 - DNA, 23 bp, Homo sapiens
ctcgccgcaggacacatcaacaa

SEQ ID NO: 29743 - DNA, 25 bp, Homo sapiens
gcagtcagaactaagacatggtccg

SEQ ID NO: 29744 - DNA, 23 bp, Homo sapiens
ctcgccgcaggacacatcaacaa

SEQ ID NO: 29745 - DNA, 25 bp, Homo sapiens
gcagtcagaactaagacatggtccg

SEQ ID NO: 29746 - DNA, 23 bp, Homo sapiens
gaagcagccactcaccacagacc

SEQ ID NO: 29747 - DNA, 24 bp, Homo sapiens
acaagcgggtgaagaagcttcccc

SEQ ID NO: 29748 - DNA, 24 bp, Homo sapiens
gacaagcgggtgaagaagcttccc

SEQ ID NO: 29749 - DNA, 24 bp, Homo sapiens
ggacaagcgggtgaagaagcttcc

SEQ ID NO: 29750 - DNA, 25 bp, Homo sapiens
ctctacagcttcgtgtggttccact

SEQ ID NO: 29751 - DNA, 23 bp, Homo sapiens
ctgctgctgctgctggtcggcgt

SEQ ID NO: 29752 - DNA, 23 bp, Homo sapiens
gggagcgggatggaaaccagcag

SEQ ID NO: 29753 - DNA, 23 bp, Homo sapiens
tctttgagcaccaccaccacctg

SEQ ID NO: 29754 - DNA, 24 bp, Homo sapiens
gccattgtcggtgctcactttcca

SEQ ID NO: 29755 - DNA, 23 bp, Homo sapiens
gcggtggttgtccctccctgtcc

SEQ ID NO: 29756 - DNA, 23 bp, Homo sapiens
cctggtggcggacgggctgaagc

SEQ ID NO: 29757 - DNA, 23 bp, Homo sapiens
ggaaggacctcatcaccgggcag

SEQ ID NO: 29758 - DNA, 23 bp, Homo sapiens
ctgaccaccctctgcccggccct

SEQ ID NO: 29759 - DNA, 24 bp, Homo sapiens
tacttcaatagccttttatgtcac

SEQ ID NO: 29760 - DNA, 24 bp, Homo sapiens
ttacttcaatagccttttatgtca

SEQ ID NO: 29761 - DNA, 24 bp, Homo sapiens
tttacttcaatagccttttatgtc

SEQ ID NO: 29762 - DNA, 23 bp, Homo sapiens
gcagcaaggagaggcggcggcgg

SEQ ID NO: 29763 - DNA, 24 bp, Homo sapiens
ggcagttggagaagaggtaagcgg

SEQ ID NO: 29764 - DNA, 23 bp, Homo sapiens
taaagagggccacgagctgcgaa

SEQ ID NO: 29765 - DNA, 24 bp, Homo sapiens
gtttattatagataatgatgaacc

SEQ ID NO: 29766 - DNA, 24 bp, Homo sapiens
tgtttattatagataatgatgaac

SEQ ID NO: 29767 - DNA, 24 bp, Homo sapiens
ttgtttattatagataatgatgaa

SEQ ID NO: 29768 - DNA, 23 bp, Homo sapiens
accgatgagtgaggagaggcgtc

SEQ ID NO: 29769 - DNA, 24 bp, Homo sapiens
gaggaggtggagcagatgaagagc

SEQ ID NO: 29770 - DNA, 23 bp, Homo sapiens
gccgaccagcaagagcgagaggg

SEQ ID NO: 29771 - DNA, 25 bp, Homo sapiens
cgaagacgacgacgacgaagaagag

SEQ ID NO: 29772 - DNA, 25 bp, Homo sapiens
gcattcctaatcagcctcctcaccg

SEQ ID NO: 29773 - DNA, 23 bp, Homo sapiens
cggcgtcttacatgctcgtgaac

SEQ ID NO: 29774 - DNA, 23 bp, Homo sapiens
tctcacctgggctctgcgtatcc

SEQ ID NO: 29775 - DNA, 23 bp, Homo sapiens
ggtcctcattctggcggttgtgg

SEQ ID NO: 29776 - DNA, 23 bp, Homo sapiens
cacagcagcctggacatcgcctc

SEQ ID NO: 29777 - DNA, 23 bp, Homo sapiens
ggtcctcattctggcggttgtgg

SEQ ID NO: 29778 - DNA, 25 bp, Homo sapiens
gctgtttctatgggaatacggcgac

SEQ ID NO: 29779 - DNA, 23 bp, Homo sapiens
gggcccaaccagcgcccagcccc

SEQ ID NO: 29780 - DNA, 24 bp, Homo sapiens
ggaattcacagttcatccacaccc

SEQ ID NO: 29781 - DNA, 24 bp, Homo sapiens
aggaattcacagttcatccacacc

SEQ ID NO: 29782 - DNA, 24 bp, Homo sapiens
aaggaattcacagttcatccacac

SEQ ID NO: 29783 - DNA, 24 bp, Homo sapiens
ttattgttttgcaccctttgacaa

SEQ ID NO: 29784 - DNA, 24 bp, Homo sapiens
gttattgttttgcaccctttgaca

SEQ ID NO: 29785 - DNA, 24 bp, Homo sapiens
tgttattgttttgcaccctttgac

SEQ ID NO: 29786 - DNA, 24 bp, Homo sapiens
atgccttgcagggctgtttcaact

SEQ ID NO: 29787 - DNA, 24 bp, Homo sapiens
aatgccttgcagggctgtttcaac

SEQ ID NO: 29788 - DNA, 24 bp, Homo sapiens
aaatgccttgcagggctgtttcaa

SEQ ID NO: 29789 - DNA, 24 bp, Homo sapiens
ggtcgcaagcacagactattccat

SEQ ID NO: 29790 - DNA, 25 bp, Homo sapiens
gtagaggttgtagatggagtgaagc

SEQ ID NO: 29791 - DNA, 24 bp, Homo sapiens
aaatcatagcagtggcgggaaggc

SEQ ID NO: 29792 - DNA, 23 bp, Homo sapiens
cgacgagcggagcctcaggagcc

SEQ ID NO: 29793 - DNA, 23 bp, Homo sapiens
gccgccgccgccgtgagtcccgc

SEQ ID NO: 29794 - DNA, 23 bp, Homo sapiens
cgcgcccccggctgggccgagcc

SEQ ID NO: 29795 - DNA, 23 bp, Homo sapiens
gatggcgagaggctgcggctgta

SEQ ID NO: 29796 - DNA, 23 bp, Homo sapiens
acatattgccgagtggatgccgc

SEQ ID NO: 29797 - DNA, 25 bp, Homo sapiens
catctgctgggataactggaggaag

SEQ ID NO: 29798 - DNA, 24 bp, Homo sapiens
acagaaaagagcaaaaacatatta

SEQ ID NO: 29799 - DNA, 24 bp, Homo sapiens
aacagaaaagagcaaaaacatatt

SEQ ID NO: 29800 - DNA, 24 bp, Homo sapiens
caacagaaaagagcaaaaacatat

SEQ ID NO: 29801 - DNA, 24 bp, Homo sapiens
catcagcaaaggaaaatataaaca

SEQ ID NO: 29802 - DNA, 24 bp, Homo sapiens
acatcagcaaaggaaaatataaac

SEQ ID NO: 29803 - DNA, 24 bp, Homo sapiens
aacatcagcaaaggaaaatataaa

SEQ ID NO: 29804 - DNA, 24 bp, Homo sapiens
cgtttatggaggaaaacatagaaa

SEQ ID NO: 29805 - DNA, 24 bp, Homo sapiens
tcgtttatggaggaaaacatagaa

SEQ ID NO: 29806 - DNA, 24 bp, Homo sapiens
atcgtttatggaggaaaacataga

SEQ ID NO: 29807 - DNA, 23 bp, Homo sapiens
tgcttgctcatcattctggggcg

SEQ ID NO: 29808 - DNA, 23 bp, Homo sapiens
cgtcgtggcggtggtggtgttcg

SEQ ID NO: 29809 - DNA, 23 bp, Homo sapiens
attcccgagcaggtgaagaaggc

SEQ ID NO: 29810 - DNA, 24 bp, Homo sapiens
taactcacaagaatgtaacacact

SEQ ID NO: 29811 - DNA, 24 bp, Homo sapiens
ataactcacaagaatgtaacacac

SEQ ID NO: 29812 - DNA, 24 bp, Homo sapiens
gataactcacaagaatgtaacaca

SEQ ID NO: 29813 - DNA, 24 bp, Homo sapiens
tggaaagcaagtgggaagatgtaa

SEQ ID NO: 29814 - DNA, 24 bp, Homo sapiens
atggaaagcaagtgggaagatgta

SEQ ID NO: 29815 - DNA, 24 bp, Homo sapiens
tatggaaagcaagtgggaagatgt

SEQ ID NO: 29816 - DNA, 23 bp, Homo sapiens
ttggcgggtgctgtggatttgag

SEQ ID NO: 29817 - DNA, 25 bp, Homo sapiens
gggagtattgggagaatctgctgcc

SEQ ID NO: 29818 - DNA, 24 bp, Homo sapiens
acctttctgtccttcgctgtcaaa

SEQ ID NO: 29819 - DNA, 24 bp, Homo sapiens
tcggtgctgaagctgctcaatacg

SEQ ID NO: 29820 - DNA, 23 bp, Homo sapiens
caagaccggtgcggagctcgtga

SEQ ID NO: 29821 - DNA, 23 bp, Homo sapiens
ggtgctgttggggctgctgctgg

SEQ ID NO: 29822 - DNA, 24 bp, Homo sapiens
cattagaaaatgtacatggtttag

SEQ ID NO: 29823 - DNA, 24 bp, Homo sapiens
acattagaaaatgtacatggttta

SEQ ID NO: 29824 - DNA, 24 bp, Homo sapiens
aacattagaaaatgtacatggttt

SEQ ID NO: 29825 - DNA, 25 bp, Homo sapiens
gttcaggagtatcaggttgggcagc

SEQ ID NO: 29826 - DNA, 25 bp, Homo sapiens
agaatgagactggtggtggagaagg

SEQ ID NO: 29827 - DNA, 25 bp, Homo sapiens
atgagaaagcctggaatgcgtaccc

SEQ ID NO: 29828 - DNA, 23 bp, Homo sapiens
tgtgagccaccgagactgaacca

SEQ ID NO: 29829 - DNA, 23 bp, Homo sapiens
cgccaccaaccagcctcgcagag

SEQ ID NO: 29830 - DNA, 24 bp, Homo sapiens
tggagcagtgacagcacaggagat

SEQ ID NO: 29831 - DNA, 25 bp, Homo sapiens
gcaatggcataatctcggctcactg

SEQ ID NO: 29832 - DNA, 24 bp, Homo sapiens
caggaggctgaggcaggagaatct

SEQ ID NO: 29833 - DNA, 24 bp, Homo sapiens
agtcctgctcttctgctcagacgg

SEQ ID NO: 29834 - DNA, 23 bp, Homo sapiens
agcacgagtcacccgttctacga

SEQ ID NO: 29835 - DNA, 24 bp, Homo sapiens
tgaccgctttggaagacgtgttgt

SEQ ID NO: 29836 - DNA, 23 bp, Homo sapiens
gctgggtgcagtgaggaagaggc

SEQ ID NO: 29837 - DNA, 25 bp, Homo sapiens
cacgaacaccttaaatacgaccagc

SEQ ID NO: 29838 - DNA, 25 bp, Homo sapiens
aggtcctgtggaacatcttgaagcc

SEQ ID NO: 29839 - DNA, 24 bp, Homo sapiens
ctcccacctcagcctcccaaagta

SEQ ID NO: 29840 - DNA, 24 bp, Homo sapiens
aggatatataggtaaagatgattc

SEQ ID NO: 29841 - DNA, 24 bp, Homo sapiens
gaggatatataggtaaagatgatt

SEQ ID NO: 29842 - DNA, 24 bp, Homo sapiens
ggaggatatataggtaaagatgat

SEQ ID NO: 29843 - DNA, 24 bp, Homo sapiens
gccctcgcccgagccagccctcct

SEQ ID NO: 29844 - DNA, 24 bp, Homo sapiens
cgccctcgcccgagccagccctcc

SEQ ID NO: 29845 - DNA, 24 bp, Homo sapiens
ccgccctcgcccgagccagccctc

SEQ ID NO: 29846 - DNA, 24 bp, Homo sapiens
agccacaaggtcatctgcttctgt

SEQ ID NO: 29847 - DNA, 24 bp, Homo sapiens
cggtgctggctgaggatggcgtct

SEQ ID NO: 29848 - DNA, 24 bp, Homo sapiens
gccacacctgccactctcgctgat

SEQ ID NO: 29849 - DNA, 24 bp, Homo sapiens
tagcggtgaagggtgttcaaccag

SEQ ID NO: 29850 - DNA, 24 bp, Homo sapiens
ttagcggtgaagggtgttcaacca

SEQ ID NO: 29851 - DNA, 24 bp, Homo sapiens
cttagcggtgaagggtgttcaacc

SEQ ID NO: 29852 - DNA, 24 bp, Homo sapiens
gctgggctggtggtgggcatcttc

SEQ ID NO: 29853 - DNA, 24 bp, Homo sapiens
ccagaaaaccttcctgcccttgtg

SEQ ID NO: 29854 - DNA, 24 bp, Homo sapiens
gggtttcagaagaaagcctacact

SEQ ID NO: 29855 - DNA, 24 bp, Homo sapiens
aaaagtgacaagtaagttacaatt

SEQ ID NO: 29856 - DNA, 24 bp, Homo sapiens
gaaaagtgacaagtaagttacaat

SEQ ID NO: 29857 - DNA, 24 bp, Homo sapiens
agaaaagtgacaagtaagttacaa

SEQ ID NO: 29858 - DNA, 23 bp, Homo sapiens
atgctctcggtgtgggactgggc

SEQ ID NO: 29859 - DNA, 23 bp, Homo sapiens
ccgtgtgctgtgtgggcttctcc

SEQ ID NO: 29860 - DNA, 25 bp, Homo sapiens
tcagtttccctctccaccttacacg

SEQ ID NO: 29861 - DNA, 24 bp, Homo sapiens
gaaccactaaggaagggaagccgc

SEQ ID NO: 29862 - DNA, 25 bp, Homo sapiens
tcagtttccctctccaccttacacg

SEQ ID NO: 29863 - DNA, 23 bp, Homo sapiens
ccgtgtgctgtgtgggcttctcc

SEQ ID NO: 29864 - DNA, 24 bp, Homo sapiens
gccaacctttatttgctgcccacc

SEQ ID NO: 29865 - DNA, 23 bp, Homo sapiens
gaggagcagaggcagcgacacta

SEQ ID NO: 29866 - DNA, 24 bp, Homo sapiens
gaaccactaaggaagggaagccgc

SEQ ID NO: 29867 - DNA, 23 bp, Homo sapiens
ctgggcgtctacaactgctggga

SEQ ID NO: 29868 - DNA, 25 bp, Homo sapiens
cgtcatcaccaccaacaccatcttc

SEQ ID NO: 29869 - DNA, 23 bp, Homo sapiens
tggcttcttcatggcaactgtgg

SEQ ID NO: 29870 - DNA, 25 bp, Homo sapiens
tctcctggtacgccttcaacatcac

SEQ ID NO: 29871 - DNA, 23 bp, Homo sapiens
ctgggcgtctacaactgctggga

SEQ ID NO: 29872 - DNA, 25 bp, Homo sapiens
cgtcatcaccaccaacaccatcttc

SEQ ID NO: 29873 - DNA, 25 bp, Homo sapiens
cattctgagtgctctgtctgccctg

SEQ ID NO: 29874 - DNA, 24 bp, Homo sapiens
ttcattctcctgtctgtcaacccg

SEQ ID NO: 29875 - DNA, 25 bp, Homo sapiens
gcctcattgcagtgtaagttggacg

SEQ ID NO: 29876 - DNA, 23 bp, Homo sapiens
tccaaatggctcctgtcgggact

SEQ ID NO: 29877 - DNA, 23 bp, Homo sapiens
gccaaccctgctgcctgcctctg

SEQ ID NO: 29878 - DNA, 25 bp, Homo sapiens
aaccaagaattgagagcactacacc

SEQ ID NO: 29879 - DNA, 23 bp, Homo sapiens
agcgtggtggaagtcatggagga

SEQ ID NO: 29880 - DNA, 23 bp, Homo sapiens
cagccgctcgtgagtgtggtgga

SEQ ID NO: 29881 - DNA, 25 bp, Homo sapiens
gccgcctacaacactctgaagacaa

SEQ ID NO: 29882 - DNA, 24 bp, Homo sapiens
aaaagtcttaggaaaagaagtttt

SEQ ID NO: 29883 - DNA, 24 bp, Homo sapiens
aaaaagtcttaggaaaagaagttt

SEQ ID NO: 29884 - DNA, 24 bp, Homo sapiens
gaaaaagtcttaggaaaagaagtt

SEQ ID NO: 29885 - DNA, 24 bp, Homo sapiens
aagagaatgaggtagagtgttctt

SEQ ID NO: 29886 - DNA, 24 bp, Homo sapiens
gaagagaatgaggtagagtgttct

SEQ ID NO: 29887 - DNA, 24 bp, Homo sapiens
ggaagagaatgaggtagagtgttc

SEQ ID NO: 29888 - DNA, 24 bp, Homo sapiens
ttttaaaacagggaattgctttta

SEQ ID NO: 29889 - DNA, 24 bp, Homo sapiens
tttttaaaacagggaattgctttt

SEQ ID NO: 29890 - DNA, 24 bp, Homo sapiens
ttttttaaaacagggaattgcttt

SEQ ID NO: 29891 - DNA, 24 bp, Homo sapiens
cggaaattcagacagcacagttta

SEQ ID NO: 29892 - DNA, 24 bp, Homo sapiens
ccggaaattcagacagcacagttt

SEQ ID NO: 29893 - DNA, 24 bp, Homo sapiens
accggaaattcagacagcacagtt

SEQ ID NO: 29894 - DNA, 24 bp, Homo sapiens
cactccagtctgggtgacagagca

SEQ ID NO: 29895 - DNA, 23 bp, Homo sapiens
catctcaaacaaaagaagaaaaa

SEQ ID NO: 29896 - DNA, 23 bp, Homo sapiens
ggtctgcgactctggtcaactgc

SEQ ID NO: 29897 - DNA, 25 bp, Homo sapiens
gcctttagcattttcctcctctcct

SEQ ID NO: 29898 - DNA, 23 bp, Homo sapiens
ggcctccaccgctgccgcacacc

SEQ ID NO: 29899 - DNA, 24 bp, Homo sapiens
ggaggaggaggaggaggaagagga

SEQ ID NO: 29900 - DNA, 23 bp, Homo sapiens
ctcctctccacctaccgcctgct

SEQ ID NO: 29901 - DNA, 23 bp, Homo sapiens
gagttgctgctgctgtccaaggc

SEQ ID NO: 29902 - DNA, 24 bp, Homo sapiens
ctgccaccacccacctccaaaggc

SEQ ID NO: 29903 - DNA, 24 bp, Homo sapiens
atgcccaacctgccacccagcatg

SEQ ID NO: 29904 - DNA, 24 bp, Homo sapiens
caacatgcgagggcttcatagcca

SEQ ID NO: 29905 - DNA, 24 bp, Homo sapiens
tgttttctcagcattaataataag

SEQ ID NO: 29906 - DNA, 24 bp, Homo sapiens
ttgttttctcagcattaataataa

SEQ ID NO: 29907 - DNA, 24 bp, Homo sapiens
tttgttttctcagcattaataata

SEQ ID NO: 29908 - DNA, 24 bp, Homo sapiens
cctttaatcaggtatggggtaaaa

SEQ ID NO: 29909 - DNA, 24 bp, Homo sapiens
tcctttaatcaggtatggggtaaa

SEQ ID NO: 29910 - DNA, 24 bp, Homo sapiens
atcctttaatcaggtatggggtaa

SEQ ID NO: 29911 - DNA, 24 bp, Homo sapiens
gatgctgctgctgcgggccgggct

SEQ ID NO: 29912 - DNA, 24 bp, Homo sapiens
cgggatcatggtctgcggcagccc

SEQ ID NO: 29913 - DNA, 24 bp, Homo sapiens
tactggaactgcacaaactggcca

SEQ ID NO: 29914 - DNA, 24 bp, Homo sapiens
ctactggaactgcacaaactggcc

SEQ ID NO: 29915 - DNA, 24 bp, Homo sapiens
actactggaactgcacaaactggc

SEQ ID NO: 29916 - DNA, 24 bp, Homo sapiens
agactgtgatgactgggagagcgg

SEQ ID NO: 29917 - DNA, 24 bp, Homo sapiens
gcgatgatgtggctttgaagaact

SEQ ID NO: 29918 - DNA, 24 bp, Homo sapiens
gccatcaaccgccagatcaacctg

SEQ ID NO: 29919 - DNA, 24 bp, Homo sapiens
caaagaattgggtgaccacgtgac

SEQ ID NO: 29920 - DNA, 24 bp, Homo sapiens
tcaaagaattgggtgaccacgtga

SEQ ID NO: 29921 - DNA, 24 bp, Homo sapiens
atcaaagaattgggtgaccacgtg

SEQ ID NO: 29922 - DNA, 24 bp, Homo sapiens
agactgtgatgactgggagagcgg

SEQ ID NO: 29923 - DNA, 24 bp, Homo sapiens
cgaggtggccgaatcttccttcag

SEQ ID NO: 29924 - DNA, 24 bp, Homo sapiens
tggagtgtgcattacatttggaaa

SEQ ID NO: 29925 - DNA, 24 bp, Homo sapiens
actactggaactgcacaaactggc

SEQ ID NO: 29926 - DNA, 24 bp, Homo sapiens
tggagtgtgcattacatttggaaa

SEQ ID NO: 29927 - DNA, 24 bp, Homo sapiens
agactgtgatgactgggagagcgg

SEQ ID NO: 29928 - DNA, 24 bp, Homo sapiens
caagaaagcaggtgagctggggcc

SEQ ID NO: 29929 - DNA, 24 bp, Homo sapiens
ccaagaaagcaggtgagctggggc

SEQ ID NO: 29930 - DNA, 24 bp, Homo sapiens
gccaagaaagcaggtgagctgggg

SEQ ID NO: 29931 - DNA, 24 bp, Homo sapiens
ggtgctgctcctgctgggcctgag

SEQ ID NO: 29932 - DNA, 24 bp, Homo sapiens
cgctctccgactgcttccagacat

SEQ ID NO: 29933 - DNA, 24 bp, Homo sapiens
catactccatacctgggatttccg

SEQ ID NO: 29934 - DNA, 24 bp, Homo sapiens
gatggacagtaattttgatagttt

SEQ ID NO: 29935 - DNA, 24 bp, Homo sapiens
ggatggacagtaattttgatagtt

SEQ ID NO: 29936 - DNA, 24 bp, Homo sapiens
cggatggacagtaattttgatagt

SEQ ID NO: 29937 - DNA, 24 bp, Homo sapiens
ttgaatcgcaggcatcctacaaaa

SEQ ID NO: 29938 - DNA, 24 bp, Homo sapiens
attgaatcgcaggcatcctacaaa

SEQ ID NO: 29939 - DNA, 24 bp, Homo sapiens
aattgaatcgcaggcatcctacaa

SEQ ID NO: 29940 - DNA, 24 bp, Homo sapiens
ttatggaatagaacccctggagtc

SEQ ID NO: 29941 - DNA, 24 bp, Homo sapiens
tgagaaggatattgaatcaagaga

SEQ ID NO: 29942 - DNA, 24 bp, Homo sapiens
acataagaaagcagatgtttcctt

SEQ ID NO: 29943 - DNA, 24 bp, Homo sapiens
ggtgaaagacgctcaggagaaggc

SEQ ID NO: 29944 - DNA, 24 bp, Homo sapiens
ctgctgctgtgcctggtggaggtg

SEQ ID NO: 29945 - DNA, 24 bp, Homo sapiens
ggagtacctgtaccacaagcacct

SEQ ID NO: 29946 - DNA, 23 bp, Homo sapiens
tcgtggtggcagaggaggctatg

SEQ ID NO: 29947 - DNA, 23 bp, Homo sapiens
tggtggggacagaggtggctttg

SEQ ID NO: 29948 - DNA, 23 bp, Homo sapiens
gggaccgtggaggcttccgaggg

SEQ ID NO: 29949 - DNA, 24 bp, Homo sapiens
cactgcactgcggcctggacgacg

SEQ ID NO: 29950 - DNA, 24 bp, Homo sapiens
accctgactcttataaataaataa

SEQ ID NO: 29951 - DNA, 24 bp, Homo sapiens
ggtctcttggctgactgatcctgg

SEQ ID NO: 29952 - DNA, 24 bp, Homo sapiens
ccctctggctcctgtggctgctgg

SEQ ID NO: 29953 - DNA, 24 bp, Homo sapiens
atcaccatccttgtctggcactgg

SEQ ID NO: 29954 - DNA, 24 bp, Homo sapiens
aactggaaatggctctaaattatc

SEQ ID NO: 29955 - DNA, 24 bp, Homo sapiens
aaactggaaatggctctaaattat

SEQ ID NO: 29956 - DNA, 24 bp, Homo sapiens
gaaactggaaatggctctaaatta

SEQ ID NO: 29957 - DNA, 24 bp, Homo sapiens
ttatcttccaggctctaaattatc

SEQ ID NO: 29958 - DNA, 24 bp, Homo sapiens
tttatcttccaggctctaaattat

SEQ ID NO: 29959 - DNA, 24 bp, Homo sapiens
ctttatcttccaggctctaaatta

SEQ ID NO: 29960 - DNA, 25 bp, Homo sapiens
ggatgttctggaggatgaggttgtc

SEQ ID NO: 29961 - DNA, 23 bp, Homo sapiens
cgtcaccgtcaggcacctcaagg

SEQ ID NO: 29962 - DNA, 23 bp, Homo sapiens
tgtggctgggctgcgtctgcttc

SEQ ID NO: 29963 - DNA, 24 bp, Homo sapiens
cagcggcaggtggcttgtggtccc

SEQ ID NO: 29964 - DNA, 24 bp, Homo sapiens
acagcggcaggtggcttgtggtcc

SEQ ID NO: 29965 - DNA, 24 bp, Homo sapiens
cacagcggcaggtggcttgtggtc

SEQ ID NO: 29966 - DNA, 23 bp, Homo sapiens
tataaatctcctcctgcaaacag

SEQ ID NO: 29967 - DNA, 25 bp, Homo sapiens
tagtttagaagagatatataccaac

SEQ ID NO: 29968 - DNA, 23 bp, Homo sapiens
cccgagcactgacagcgaaaccg

SEQ ID NO: 29969 - DNA, 25 bp, Homo sapiens
ccatattggaggaggctgctagtcc

SEQ ID NO: 29970 - DNA, 23 bp, Homo sapiens
gcggtgactcaagcctgtaatcc

SEQ ID NO: 29971 - DNA, 24 bp, Homo sapiens
gtcacagcactggcattggaagaa

SEQ ID NO: 29972 - DNA, 24 bp, Homo sapiens
ttctcagcctggagcattaagtgg

SEQ ID NO: 29973 - DNA, 24 bp, Homo sapiens
gctgcctgcctctcaaacatcaca

SEQ ID NO: 29974 - DNA, 24 bp, Homo sapiens
ggcagatgtaaagtccctcatggc

SEQ ID NO: 29975 - DNA, 25 bp, Homo sapiens
gcactacactgaatacatacacgca

SEQ ID NO: 29976 - DNA, 25 bp, Homo sapiens
ggctggtcttgaaatcctgggttga

SEQ ID NO: 29977 - DNA, 23 bp, Homo sapiens
aaatagacttcccagagaacagc

SEQ ID NO: 29978 - DNA, 24 bp, Homo sapiens
aaattaatgaagtaagtcaaaaca

SEQ ID NO: 29979 - DNA, 24 bp, Homo sapiens
aaaattaatgaagtaagtcaaaac

SEQ ID NO: 29980 - DNA, 24 bp, Homo sapiens
aaaaattaatgaagtaagtcaaaa

SEQ ID NO: 29981 - DNA, 25 bp, Homo sapiens
ggacatcaaccacattctgaggaac

SEQ ID NO: 29982 - DNA, 24 bp, Homo sapiens
tgttctgggagggctaaggcatca

SEQ ID NO: 29983 - DNA, 24 bp, Homo sapiens
aggcagagtcagaggttccacagg

SEQ ID NO: 29984 - DNA, 24 bp, Homo sapiens
gatagtaaaaagtaagtttttatg

SEQ ID NO: 29985 - DNA, 24 bp, Homo sapiens
agatagtaaaaagtaagtttttat

SEQ ID NO: 29986 - DNA, 24 bp, Homo sapiens
gagatagtaaaaagtaagttttta

SEQ ID NO: 29987 - DNA, 23 bp, Homo sapiens
gagtggacgaggagccgacaacc

SEQ ID NO: 29988 - DNA, 23 bp, Homo sapiens
ccaagctgaccgacgaggacttc

SEQ ID NO: 29989 - DNA, 25 bp, Homo sapiens
gatgatgaggacgaggagagtgacc

SEQ ID NO: 29990 - DNA, 25 bp, Homo sapiens
tggaatcgctttcagtccttgtgga

SEQ ID NO: 29991 - DNA, 24 bp, Homo sapiens
cgtgtatgaaatgggctcaagcac

SEQ ID NO: 29992 - DNA, 23 bp, Homo sapiens
gctggctgggcacacagacactg

SEQ ID NO: 29993 - DNA, 24 bp, Homo sapiens
tgaataaatagattgaagatggaa

SEQ ID NO: 29994 - DNA, 24 bp, Homo sapiens
gtgaataaatagattgaagatgga

SEQ ID NO: 29995 - DNA, 24 bp, Homo sapiens
ggtgaataaatagattgaagatgg

SEQ ID NO: 29996 - DNA, 24 bp, Homo sapiens
ttatttatcagtgcctttgaagga

SEQ ID NO: 29997 - DNA, 24 bp, Homo sapiens
tttatttatcagtgcctttgaagg

SEQ ID NO: 29998 - DNA, 24 bp, Homo sapiens
gtttatttatcagtgcctttgaag

SEQ ID NO: 29999 - DNA, 24 bp, Homo sapiens
ttctattctagttactatttttgg

SEQ ID NO: 30000 - DNA, 24 bp, Homo sapiens
cttctattctagttactatttttg

SEQ ID NO: 30001 - DNA, 24 bp, Homo sapiens
tcttctattctagttactattttt

SEQ ID NO: 30002 - DNA, 24 bp, Homo sapiens
atattttcaagtggctcaaatcaa

SEQ ID NO: 30003 - DNA, 24 bp, Homo sapiens
aatattttcaagtggctcaaatca

SEQ ID NO: 30004 - DNA, 24 bp, Homo sapiens
caatattttcaagtggctcaaatc

SEQ ID NO: 30005 - DNA, 25 bp, Homo sapiens
aggaagactgtgaggaatcatgtga

SEQ ID NO: 30006 - DNA, 25 bp, Homo sapiens
tacatcattctacggactcttcagt

SEQ ID NO: 30007 - DNA, 24 bp, Homo sapiens
tgtctccatcccaagcctcactct

SEQ ID NO: 30008 - DNA, 24 bp, Homo sapiens
tttttctatagaaattagtgaatt

SEQ ID NO: 30009 - DNA, 24 bp, Homo sapiens
ttttttctatagaaattagtgaat

SEQ ID NO: 30010 - DNA, 24 bp, Homo sapiens
tttttttctatagaaattagtgaa

SEQ ID NO: 30011 - DNA, 24 bp, Homo sapiens
tggacaagaggttggtagtatctt

SEQ ID NO: 30012 - DNA, 24 bp, Homo sapiens
atggacaagaggttggtagtatct

SEQ ID NO: 30013 - DNA, 24 bp, Homo sapiens
aatggacaagaggttggtagtatc

SEQ ID NO: 30014 - DNA, 24 bp, Homo sapiens
tagtcattcaggtacttgttatct

SEQ ID NO: 30015 - DNA, 24 bp, Homo sapiens
atagtcattcaggtacttgttatc

SEQ ID NO: 30016 - DNA, 24 bp, Homo sapiens
catagtcattcaggtacttgttat

SEQ ID NO: 30017 - DNA, 24 bp, Homo sapiens
tcctatacttggtaggtaatgttt

SEQ ID NO: 30018 - DNA, 24 bp, Homo sapiens
atcctatacttggtaggtaatgtt

SEQ ID NO: 30019 - DNA, 24 bp, Homo sapiens
catcctatacttggtaggtaatgt

SEQ ID NO: 30020 - DNA, 24 bp, Homo sapiens
ttttaatctagtatgatgaattag

SEQ ID NO: 30021 - DNA, 24 bp, Homo sapiens
tttttaatctagtatgatgaatta

SEQ ID NO: 30022 - DNA, 24 bp, Homo sapiens
ttttttaatctagtatgatgaatt

SEQ ID NO: 30023 - DNA, 24 bp, Homo sapiens
ggaggccaggtgtgctggagctct

SEQ ID NO: 30024 - DNA, 24 bp, Homo sapiens
gggaggccaggtgtgctggagctc

SEQ ID NO: 30025 - DNA, 24 bp, Homo sapiens
agggaggccaggtgtgctggagct

SEQ ID NO: 30026 - DNA, 24 bp, Homo sapiens
tgggagatgagcttatctatttta

SEQ ID NO: 30027 - DNA, 24 bp, Homo sapiens
atgggagatgagcttatctatttt

SEQ ID NO: 30028 - DNA, 24 bp, Homo sapiens
aatgggagatgagcttatctattt

SEQ ID NO: 30029 - DNA, 24 bp, Homo sapiens
tttttatatagactgtaagagtac

SEQ ID NO: 30030 - DNA, 24 bp, Homo sapiens
ctttttatatagactgtaagagta

SEQ ID NO: 30031 - DNA, 24 bp, Homo sapiens
tctttttatatagactgtaagagt

SEQ ID NO: 30032 - DNA, 24 bp, Homo sapiens
catgacgtacctgtgccagatccg

SEQ ID NO: 30033 - DNA, 24 bp, Homo sapiens
catcaagcagaacaacaagcaggc

SEQ ID NO: 30034 - DNA, 24 bp, Homo sapiens
agacaagattgactatgcctcgct

SEQ ID NO: 30035 - DNA, 24 bp, Homo sapiens
aacagcagctcgttctcgatggac

SEQ ID NO: 30036 - DNA, 24 bp, Homo sapiens
cccctgaccccagccctgccccag

SEQ ID NO: 30037 - DNA, 24 bp, Homo sapiens
cgacgcggacctgctcaagaagag

SEQ ID NO: 30038 - DNA, 24 bp, Homo sapiens
taccaagcagtccttcctgtgcat

SEQ ID NO: 30039 - DNA, 24 bp, Homo sapiens
ctaccaagcagtccttcctgtgca

SEQ ID NO: 30040 - DNA, 24 bp, Homo sapiens
gctaccaagcagtccttcctgtgc

SEQ ID NO: 30041 - DNA, 24 bp, Homo sapiens
gtgccctgcgacttcccgtaacag

SEQ ID NO: 30042 - DNA, 24 bp, Homo sapiens
gacgcttgtgccggaaggtctcac

SEQ ID NO: 30043 - DNA, 24 bp, Homo sapiens
ggatggagtgcagtggcgcgatca

SEQ ID NO: 30044 - DNA, 24 bp, Homo sapiens
tcattactatcgaattctatgtaa

SEQ ID NO: 30045 - DNA, 24 bp, Homo sapiens
atcattactatcgaattctatgta

SEQ ID NO: 30046 - DNA, 24 bp, Homo sapiens
gatcattactatcgaattctatgt

SEQ ID NO: 30047 - DNA, 24 bp, Homo sapiens
aaaattaaacagtaagttatatgg

SEQ ID NO: 30048 - DNA, 24 bp, Homo sapiens
aaaaattaaacagtaagttatatg

SEQ ID NO: 30049 - DNA, 24 bp, Homo sapiens
aaaaaattaaacagtaagttatat

SEQ ID NO: 30050 - DNA, 23 bp, Homo sapiens
gctcgttggctggaagtgctgcg

SEQ ID NO: 30051 - DNA, 23 bp, Homo sapiens
cgagaactatctgagcggcggtg

SEQ ID NO: 30052 - DNA, 23 bp, Homo sapiens
caagtgcggctggttcgtgcgag

SEQ ID NO: 30053 - DNA, 24 bp, Homo sapiens
tactcagcaaggggatggagtgtt

SEQ ID NO: 30054 - DNA, 24 bp, Homo sapiens
atactcagcaaggggatggagtgt

SEQ ID NO: 30055 - DNA, 24 bp, Homo sapiens
aatactcagcaaggggatggagtg

SEQ ID NO: 30056 - DNA, 24 bp, Homo sapiens
tttatttgaaggattgtataccat

SEQ ID NO: 30057 - DNA, 24 bp, Homo sapiens
gtttatttgaaggattgtatacca

SEQ ID NO: 30058 - DNA, 24 bp, Homo sapiens
agtttatttgaaggattgtatacc

SEQ ID NO: 30059 - DNA, 24 bp, Homo sapiens
agtgcagagaggggccctggtcct

SEQ ID NO: 30060 - DNA, 24 bp, Homo sapiens
cagtgcagagaggggccctggtcc

SEQ ID NO: 30061 - DNA, 24 bp, Homo sapiens
ccagtgcagagaggggccctggtc

SEQ ID NO: 30062 - DNA, 23 bp, Homo sapiens
tgtgccagcccgacttgagatgc

SEQ ID NO: 30063 - DNA, 25 bp, Homo sapiens
gcctccaaagtgctgggattacagg

SEQ ID NO: 30064 - DNA, 23 bp, Homo sapiens
tgcaggtgttgttctgaccccag

SEQ ID NO: 30065 - DNA, 23 bp, Homo sapiens
agcctggagagtcgaagcagcag

SEQ ID NO: 30066 - DNA, 25 bp, Homo sapiens
ggactctgtggagatgcctgtaacc

SEQ ID NO: 30067 - DNA, 23 bp, Homo sapiens
gctcctgccctgcttcctgtgat

SEQ ID NO: 30068 - DNA, 24 bp, Homo sapiens
ggccagtgtggagcaccatcctcc

SEQ ID NO: 30069 - DNA, 24 bp, Homo sapiens
aggccagtgtggagcaccatcctc

SEQ ID NO: 30070 - DNA, 24 bp, Homo sapiens
gaggccagtgtggagcaccatcct

SEQ ID NO: 30071 - DNA, 23 bp, Homo sapiens
gtccagccagaagaagagccaaa

SEQ ID NO: 30072 - DNA, 23 bp, Homo sapiens
caccaccgtgattccttccaagg

SEQ ID NO: 30073 - DNA, 25 bp, Homo sapiens
cgggaagaggaggctgaaatgatgc

SEQ ID NO: 30074 - DNA, 24 bp, Homo sapiens
ggccgcgtgctgctgaacacgacg

SEQ ID NO: 30075 - DNA, 24 bp, Homo sapiens
cggccgcgtgctgctgaacacgac

SEQ ID NO: 30076 - DNA, 24 bp, Homo sapiens
acggccgcgtgctgctgaacacga

SEQ ID NO: 30077 - DNA, 24 bp, Homo sapiens
tttgaatacagatgaaagttttag

SEQ ID NO: 30078 - DNA, 24 bp, Homo sapiens
ttttgaatacagatgaaagtttta

SEQ ID NO: 30079 - DNA, 24 bp, Homo sapiens
cttttgaatacagatgaaagtttt

SEQ ID NO: 30080 - DNA, 24 bp, Homo sapiens
atgaaattaagaaatttggtacaa

SEQ ID NO: 30081 - DNA, 24 bp, Homo sapiens
gatgaaattaagaaatttggtaca

SEQ ID NO: 30082 - DNA, 24 bp, Homo sapiens
tgatgaaattaagaaatttggtac

SEQ ID NO: 30083 - DNA, 24 bp, Homo sapiens
cctatctattgaaaaataatttca

SEQ ID NO: 30084 - DNA, 24 bp, Homo sapiens
ccctatctattgaaaaataatttc

SEQ ID NO: 30085 - DNA, 24 bp, Homo sapiens
accctatctattgaaaaataattt

SEQ ID NO: 30086 - DNA, 24 bp, Homo sapiens
cggggcgcacggtcagggggctgg

SEQ ID NO: 30087 - DNA, 24 bp, Homo sapiens
acggggcgcacggtcagggggctg

SEQ ID NO: 30088 - DNA, 24 bp, Homo sapiens
tacggggcgcacggtcagggggct

SEQ ID NO: 30089 - DNA, 24 bp, Homo sapiens
aacagaagaaggtaagttcaagat

SEQ ID NO: 30090 - DNA, 24 bp, Homo sapiens
caacagaagaaggtaagttcaaga

SEQ ID NO: 30091 - DNA, 24 bp, Homo sapiens
ccaacagaagaaggtaagttcaag

SEQ ID NO: 30092 - DNA, 23 bp, Homo sapiens
ggctgctgctgctgctgggaatc

SEQ ID NO: 30093 - DNA, 25 bp, Homo sapiens
gcttatgagaccaagagtgtgtcca

SEQ ID NO: 30094 - DNA, 23 bp, Homo sapiens
atcaatgatcaccgggctgtggg

SEQ ID NO: 30095 - DNA, 24 bp, Homo sapiens
ccaggaaacaggaaagtattttat

SEQ ID NO: 30096 - DNA, 24 bp, Homo sapiens
gccaggaaacaggaaagtatttta

SEQ ID NO: 30097 - DNA, 24 bp, Homo sapiens
cgccaggaaacaggaaagtatttt

SEQ ID NO: 30098 - DNA, 24 bp, Homo sapiens
cccagcccaagaccccgacttccg

SEQ ID NO: 30099 - DNA, 24 bp, Homo sapiens
acccagcccaagaccccgacttcc

SEQ ID NO: 30100 - DNA, 24 bp, Homo sapiens
cacccagcccaagaccccgacttc

SEQ ID NO: 30101 - DNA, 23 bp, Homo sapiens
gccacgcagccgcccgccgccag

SEQ ID NO: 30102 - DNA, 23 bp, Homo sapiens
gccaccgggcgccggagccagcc

SEQ ID NO: 30103 - DNA, 24 bp, Homo sapiens
gaatttctaaggtcaaagatgttg

SEQ ID NO: 30104 - DNA, 24 bp, Homo sapiens
tgaatttctaaggtcaaagatgtt

SEQ ID NO: 30105 - DNA, 24 bp, Homo sapiens
atgaatttctaaggtcaaagatgt

SEQ ID NO: 30106 - DNA, 23 bp, Homo sapiens
ggtgaacagcaagcagtccaggt

SEQ ID NO: 30107 - DNA, 25 bp, Homo sapiens
tctattaccgcctctacctggagca

SEQ ID NO: 30108 - DNA, 23 bp, Homo sapiens
gacaccatctgcctgactgcctg

SEQ ID NO: 30109 - DNA, 24 bp, Homo sapiens
accatgacaagaaattccaacaga

SEQ ID NO: 30110 - DNA, 24 bp, Homo sapiens
taccatgacaagaaattccaacag

SEQ ID NO: 30111 - DNA, 24 bp, Homo sapiens
ataccatgacaagaaattccaaca

SEQ ID NO: 30112 - DNA, 25 bp, Homo sapiens
agcctcctgaagagttgagattact

SEQ ID NO: 30113 - DNA, 23 bp, Homo sapiens
ctcctggcctcaagtgatcctcc

SEQ ID NO: 30114 - DNA, 24 bp, Homo sapiens
tgaagaaacaaaccagaaggaacc

SEQ ID NO: 30115 - DNA, 24 bp, Homo sapiens
ctgaagaaacaaaccagaaggaac

SEQ ID NO: 30116 - DNA, 24 bp, Homo sapiens
actgaagaaacaaaccagaaggaa

SEQ ID NO: 30117 - DNA, 24 bp, Homo sapiens
ttggtctaacaattgtcattcctt

SEQ ID NO: 30118 - DNA, 24 bp, Homo sapiens
tttggtctaacaattgtcattcct

SEQ ID NO: 30119 - DNA, 24 bp, Homo sapiens
ttttggtctaacaattgtcattcc

SEQ ID NO: 30120 - DNA, 23 bp, Homo sapiens
aagccaccagcctccatccacag

SEQ ID NO: 30121 - DNA, 23 bp, Homo sapiens
gaactggagcggctgcggcacat

SEQ ID NO: 30122 - DNA, 24 bp, Homo sapiens
cttcagtgacaagaccagcaacct

SEQ ID NO: 30123 - DNA, 24 bp, Homo sapiens
aacaatcttctaaaaaagaaaagg

SEQ ID NO: 30124 - DNA, 24 bp, Homo sapiens
aaacaatcttctaaaaaagaaaag

SEQ ID NO: 30125 - DNA, 24 bp, Homo sapiens
caaacaatcttctaaaaaagaaaa

SEQ ID NO: 30126 - DNA, 24 bp, Homo sapiens
taaatttccaggcatagatattct

SEQ ID NO: 30127 - DNA, 24 bp, Homo sapiens
ttaaatttccaggcatagatattc

SEQ ID NO: 30128 - DNA, 24 bp, Homo sapiens
tttaaatttccaggcatagatatt

SEQ ID NO: 30129 - DNA, 24 bp, Homo sapiens
ttggtgaaacagtaagcttatttt

SEQ ID NO: 30130 - DNA, 24 bp, Homo sapiens
attggtgaaacagtaagcttattt

SEQ ID NO: 30131 - DNA, 24 bp, Homo sapiens
aattggtgaaacagtaagcttatt

SEQ ID NO: 30132 - DNA, 24 bp, Homo sapiens
aagtcggtggtggtggcggaagat

SEQ ID NO: 30133 - DNA, 24 bp, Homo sapiens
gactgaaccagtaccacctgatgg

SEQ ID NO: 30134 - DNA, 24 bp, Homo sapiens
agtcgtttacgtctggaccaacgg

SEQ ID NO: 30135 - DNA, 23 bp, Homo sapiens
agcagcagcagcagtgaagaagg

SEQ ID NO: 30136 - DNA, 23 bp, Homo sapiens
ggctccccagtggagacgaggcc

SEQ ID NO: 30137 - DNA, 25 bp, Homo sapiens
acccagacccacctactgaatctcg

SEQ ID NO: 30138 - DNA, 24 bp, Homo sapiens
agagaagttctggtcaaccttgcc

SEQ ID NO: 30139 - DNA, 23 bp, Homo sapiens
agcagcagcagcagtgaagaagg

SEQ ID NO: 30140 - DNA, 24 bp, Homo sapiens
acaatcattctgtgagtatctcat

SEQ ID NO: 30141 - DNA, 24 bp, Homo sapiens
tacaatcattctgtgagtatctca

SEQ ID NO: 30142 - DNA, 24 bp, Homo sapiens
ttacaatcattctgtgagtatctc

SEQ ID NO: 30143 - DNA, 24 bp, Homo sapiens
aggaaaaaaagaaaaaatgaaggt

SEQ ID NO: 30144 - DNA, 24 bp, Homo sapiens
caggaaaaaaagaaaaaatgaagg

SEQ ID NO: 30145 - DNA, 24 bp, Homo sapiens
tcaggaaaaaaagaaaaaatgaag

SEQ ID NO: 30146 - DNA, 24 bp, Homo sapiens
gctcagcctggatagattggagat

SEQ ID NO: 30147 - DNA, 24 bp, Homo sapiens
tggctgtggttaagtattggatgg

SEQ ID NO: 30148 - DNA, 24 bp, Homo sapiens
ggaatgcttgatctgaacactggt

SEQ ID NO: 30149 - DNA, 23 bp, Homo sapiens
gctctagcaggtggaccaactct

SEQ ID NO: 30150 - DNA, 25 bp, Homo sapiens
tgctcacctgatgatggacactatg

SEQ ID NO: 30151 - DNA, 25 bp, Homo sapiens
atctgaagactgccatgactccaca

SEQ ID NO: 30152 - DNA, 24 bp, Homo sapiens
cgcaaggacttcgtggtagcagtg

SEQ ID NO: 30153 - DNA, 24 bp, Homo sapiens
aggaggtgcggctggactgtgagg

SEQ ID NO: 30154 - DNA, 24 bp, Homo sapiens
cggttctacctggacggcggctcc

SEQ ID NO: 30155 - DNA, 24 bp, Homo sapiens
cccaggctgaggcccgcaaggact

SEQ ID NO: 30156 - DNA, 24 bp, Homo sapiens
cctccagctgagccgcctgcaacc

SEQ ID NO: 30157 - DNA, 24 bp, Homo sapiens
gcgggcacctacacgtgcgtggct

SEQ ID NO: 30158 - DNA, 24 bp, Homo sapiens
aggaggtgcggctggactgtgagg

SEQ ID NO: 30159 - DNA, 24 bp, Homo sapiens
cggttctacctggacggcggctcc

SEQ ID NO: 30160 - DNA, 24 bp, Homo sapiens
acacggtgaatgtgctggttcctc

SEQ ID NO: 30161 - DNA, 24 bp, Homo sapiens
aggaggtgcggctggactgtgagg

SEQ ID NO: 30162 - DNA, 24 bp, Homo sapiens
cgcaaggacttcgtggtagcagtg

SEQ ID NO: 30163 - DNA, 24 bp, Homo sapiens
tcacttggctgaaggacaggatgc

SEQ ID NO: 30164 - DNA, 24 bp, Homo sapiens
tattgttacagcctacagagaatc

SEQ ID NO: 30165 - DNA, 24 bp, Homo sapiens
ttattgttacagcctacagagaat

SEQ ID NO: 30166 - DNA, 24 bp, Homo sapiens
cttattgttacagcctacagagaa

SEQ ID NO: 30167 - DNA, 23 bp, Homo sapiens
aaacgcggaaatgcggtggctgc

SEQ ID NO: 30168 - DNA, 23 bp, Homo sapiens
ccccgcccccacctcccgcctac

SEQ ID NO: 30169 - DNA, 24 bp, Homo sapiens
aacacggggaggtggttggttttg

SEQ ID NO: 30170 - DNA, 24 bp, Homo sapiens
gaacacggggaggtggttggtttt

SEQ ID NO: 30171 - DNA, 24 bp, Homo sapiens
tgaacacggggaggtggttggttt

SEQ ID NO: 30172 - DNA, 24 bp, Homo sapiens
ttacaatttggaaggcatctcagt

SEQ ID NO: 30173 - DNA, 24 bp, Homo sapiens
attacaatttggaaggcatctcag

SEQ ID NO: 30174 - DNA, 24 bp, Homo sapiens
aattacaatttggaaggcatctca

SEQ ID NO: 30175 - DNA, 25 bp, Homo sapiens
ctattccattcatcgctacgcctgt

SEQ ID NO: 30176 - DNA, 24 bp, Homo sapiens
aagattacagatgtgagccactgc

SEQ ID NO: 30177 - DNA, 25 bp, Homo sapiens
ttgctctactgtttaggtctgtggt

SEQ ID NO: 30178 - DNA, 25 bp, Homo sapiens
ttccttgttcccttccatgcctagc

SEQ ID NO: 30179 - DNA, 23 bp, Homo sapiens
ccttctgtagctcaagagagcac

SEQ ID NO: 30180 - DNA, 25 bp, Homo sapiens
accccatttgctcacagtatcctat

SEQ ID NO: 30181 - DNA, 25 bp, Homo sapiens
cctcctctacctcctctacctggct

SEQ ID NO: 30182 - DNA, 23 bp, Homo sapiens
cctgctccgatggctacctgtac

SEQ ID NO: 30183 - DNA, 23 bp, Homo sapiens
cgtggtggcctggtgtcgcctgg

SEQ ID NO: 30184 - DNA, 24 bp, Homo sapiens
ctgtcctcaggcagagcatcgcag

SEQ ID NO: 30185 - DNA, 24 bp, Homo sapiens
ggcaacaggcaggcagtaaagaca

SEQ ID NO: 30186 - DNA, 24 bp, Homo sapiens
acacagcatgtcttgtaccgagca

SEQ ID NO: 30187 - DNA, 24 bp, Homo sapiens
ataaagcctcggtatgttaaaaag

SEQ ID NO: 30188 - DNA, 24 bp, Homo sapiens
aataaagcctcggtatgttaaaaa

SEQ ID NO: 30189 - DNA, 24 bp, Homo sapiens
aaataaagcctcggtatgttaaaa

SEQ ID NO: 30190 - DNA, 23 bp, Homo sapiens
aggagaggacagcacagccagag

SEQ ID NO: 30191 - DNA, 25 bp, Homo sapiens
cgggatggagacaaagaagacaagg

SEQ ID NO: 30192 - DNA, 25 bp, Homo sapiens
ccgtctcagatacaaggacagagcg

SEQ ID NO: 30193 - DNA, 24 bp, Homo sapiens
ctatcaatatgcaccattaaagtc

SEQ ID NO: 30194 - DNA, 24 bp, Homo sapiens
gctatcaatatgcaccattaaagt

SEQ ID NO: 30195 - DNA, 24 bp, Homo sapiens
cgctatcaatatgcaccattaaag

SEQ ID NO: 30196 - DNA, 24 bp, Homo sapiens
gctcactacagccttcgcttctgg

SEQ ID NO: 30197 - DNA, 23 bp, Homo sapiens
aggctggaatgtgcagtggtgtg

SEQ ID NO: 30198 - DNA, 23 bp, Homo sapiens
actgatcctcccaccttggcctc

SEQ ID NO: 30199 - DNA, 24 bp, Homo sapiens
atggcagaaaggttcatggagttt

SEQ ID NO: 30200 - DNA, 24 bp, Homo sapiens
gatggcagaaaggttcatggagtt

SEQ ID NO: 30201 - DNA, 24 bp, Homo sapiens
agatggcagaaaggttcatggagt

SEQ ID NO: 30202 - DNA, 23 bp, Homo sapiens
gcctcagcctccaccaccagttg

SEQ ID NO: 30203 - DNA, 25 bp, Homo sapiens
accctctgatgctctctgctttccc

SEQ ID NO: 30204 - DNA, 23 bp, Homo sapiens
gccactctatccaagccttccct

SEQ ID NO: 30205 - DNA, 25 bp, Homo sapiens
aataaacgcctgtcttcatccaccg

SEQ ID NO: 30206 - DNA, 25 bp, Homo sapiens
gaccgagtattccatgtctgtcctc

SEQ ID NO: 30207 - DNA, 24 bp, Homo sapiens
gcaggagatgttgggaaagaagcc

SEQ ID NO: 30208 - DNA, 24 bp, Homo sapiens
atggatgtgagtcctgtttcaaaa

SEQ ID NO: 30209 - DNA, 24 bp, Homo sapiens
tatggatgtgagtcctgtttcaaa

SEQ ID NO: 30210 - DNA, 24 bp, Homo sapiens
ctatggatgtgagtcctgtttcaa

SEQ ID NO: 30211 - DNA, 24 bp, Homo sapiens
agaagtttaaagtaagacgaagag

SEQ ID NO: 30212 - DNA, 24 bp, Homo sapiens
gagaagtttaaagtaagacgaaga

SEQ ID NO: 30213 - DNA, 24 bp, Homo sapiens
agagaagtttaaagtaagacgaag

SEQ ID NO: 30214 - DNA, 24 bp, Homo sapiens
tccttttgaaggaaaagcaagatg

SEQ ID NO: 30215 - DNA, 24 bp, Homo sapiens
ttccttttgaaggaaaagcaagat

SEQ ID NO: 30216 - DNA, 24 bp, Homo sapiens
tttccttttgaaggaaaagcaaga

SEQ ID NO: 30217 - DNA, 24 bp, Homo sapiens
aatgttggaaggtttatgattatt

SEQ ID NO: 30218 - DNA, 24 bp, Homo sapiens
aaatgttggaaggtttatgattat

SEQ ID NO: 30219 - DNA, 24 bp, Homo sapiens
taaatgttggaaggtttatgatta

SEQ ID NO: 30220 - DNA, 24 bp, Homo sapiens
ggacacgatcagcagggagaacac

SEQ ID NO: 30221 - DNA, 24 bp, Homo sapiens
gatgaggatgaaatttgggcttga

SEQ ID NO: 30222 - DNA, 24 bp, Homo sapiens
tttatgagaattacgctgagatag

SEQ ID NO: 30223 - DNA, 24 bp, Homo sapiens
gcagagggctgactgtggctagaa

SEQ ID NO: 30224 - DNA, 24 bp, Homo sapiens
agcgacgcagaagacgggtgattt

SEQ ID NO: 30225 - DNA, 24 bp, Homo sapiens
tgcagcccctgtttgggagcagct

SEQ ID NO: 30226 - DNA, 23 bp, Homo sapiens
gtgaggcaggaagaggaggacat

SEQ ID NO: 30227 - DNA, 23 bp, Homo sapiens
cgaggtcaaccgccagaaccgag

SEQ ID NO: 30228 - DNA, 24 bp, Homo sapiens
catcgcaagcctgctcctggatac

SEQ ID NO: 30229 - DNA, 24 bp, Homo sapiens
caagaccaaagaactcagaaaagc

SEQ ID NO: 30230 - DNA, 24 bp, Homo sapiens
acaagaccaaagaactcagaaaag

SEQ ID NO: 30231 - DNA, 24 bp, Homo sapiens
gacaagaccaaagaactcagaaaa

SEQ ID NO: 30232 - DNA, 24 bp, Homo sapiens
ggtccaaaatcttctagatgaaca

SEQ ID NO: 30233 - DNA, 24 bp, Homo sapiens
gggtccaaaatcttctagatgaac

SEQ ID NO: 30234 - DNA, 24 bp, Homo sapiens
tgggtccaaaatcttctagatgaa

SEQ ID NO: 30235 - DNA, 24 bp, Homo sapiens
atgggagtgtggctggcttcatgg

SEQ ID NO: 30236 - DNA, 24 bp, Homo sapiens
gcggctcaccctggcatctactcc

SEQ ID NO: 30237 - DNA, 24 bp, Homo sapiens
ataagtctccaagcctcgtctcgc

SEQ ID NO: 30238 - DNA, 24 bp, Homo sapiens
gcggcattactggaaggatgagag

SEQ ID NO: 30239 - DNA, 24 bp, Homo sapiens
cgccagcaacaagagcatgacctt

SEQ ID NO: 30240 - DNA, 24 bp, Homo sapiens
atgacaccaccactgacaacatca

SEQ ID NO: 30241 - DNA, 24 bp, Homo sapiens
ggggacctgagtttctgtaaccta

SEQ ID NO: 30242 - DNA, 24 bp, Homo sapiens
tggggacctgagtttctgtaacct

SEQ ID NO: 30243 - DNA, 24 bp, Homo sapiens
ctggggacctgagtttctgtaacc

SEQ ID NO: 30244 - DNA, 23 bp, Homo sapiens
ctgctgctgtggctgagctgcta

SEQ ID NO: 30245 - DNA, 23 bp, Homo sapiens
gtggccgaggcggttgggcggag

SEQ ID NO: 30246 - DNA, 23 bp, Homo sapiens
gcgccatgtcagcccgggaagtg

SEQ ID NO: 30247 - DNA, 24 bp, Homo sapiens
gtggtggagctgtggcgaaaagac

SEQ ID NO: 30248 - DNA, 24 bp, Homo sapiens
cgtggtggagctgtggcgaaaaga

SEQ ID NO: 30249 - DNA, 24 bp, Homo sapiens
ccgtggtggagctgtggcgaaaag

SEQ ID NO: 30250 - DNA, 25 bp, Homo sapiens
ttcatcctacaacaacacgcttgat

SEQ ID NO: 30251 - DNA, 23 bp, Homo sapiens
cgttctcgcacagtgaggacagg

SEQ ID NO: 30252 - DNA, 23 bp, Homo sapiens
tgctgatgttgatgctggtggcg

SEQ ID NO: 30253 - DNA, 25 bp, Homo sapiens
gacagacaggcagaaatcattgggt

SEQ ID NO: 30254 - DNA, 25 bp, Homo sapiens
aggttgcgatgcttgtagtgaatca

SEQ ID NO: 30255 - DNA, 24 bp, Homo sapiens
gagaggcatcctgctcctatggtt

SEQ ID NO: 30256 - DNA, 24 bp, Homo sapiens
agaacatccaggaaaaaaatactc

SEQ ID NO: 30257 - DNA, 24 bp, Homo sapiens
gagaacatccaggaaaaaaatact

SEQ ID NO: 30258 - DNA, 24 bp, Homo sapiens
agagaacatccaggaaaaaaatac

SEQ ID NO: 30259 - DNA, 24 bp, Homo sapiens
tgcacaaggagtgtatcaaattct

SEQ ID NO: 30260 - DNA, 24 bp, Homo sapiens
ttgcacaaggagtgtatcaaattc

SEQ ID NO: 30261 - DNA, 24 bp, Homo sapiens
attgcacaaggagtgtatcaaatt

SEQ ID NO: 30262 - DNA, 24 bp, Homo sapiens
atgaagcagcagcagcagatggaa

SEQ ID NO: 30263 - DNA, 25 bp, Homo sapiens
acaggattccacggagagaccaaag

SEQ ID NO: 30264 - DNA, 25 bp, Homo sapiens
aacaaggacattagtgctccagtgg

SEQ ID NO: 30265 - DNA, 24 bp, Homo sapiens
ctttattttagggccaactctgtg

SEQ ID NO: 30266 - DNA, 24 bp, Homo sapiens
tctttattttagggccaactctgt

SEQ ID NO: 30267 - DNA, 24 bp, Homo sapiens
ttctttattttagggccaactctg

SEQ ID NO: 30268 - DNA, 24 bp, Homo sapiens
ttcaaagaaagaggtcttcagttc

SEQ ID NO: 30269 - DNA, 24 bp, Homo sapiens
cttcaaagaaagaggtcttcagtt

SEQ ID NO: 30270 - DNA, 24 bp, Homo sapiens
gcttcaaagaaagaggtcttcagt

SEQ ID NO: 30271 - DNA, 25 bp, Homo sapiens
tggcagaatcagagttcattgtgtc

SEQ ID NO: 30272 - DNA, 25 bp, Homo sapiens
gctgtaacactcaccacgaaggtct

SEQ ID NO: 30273 - DNA, 25 bp, Homo sapiens
cgtgggcagggacaaataagggaat

SEQ ID NO: 30274 - DNA, 24 bp, Homo sapiens
tttttaaatagaaaatgactgtgg

SEQ ID NO: 30275 - DNA, 24 bp, Homo sapiens
ttttttaaatagaaaatgactgtg

SEQ ID NO: 30276 - DNA, 24 bp, Homo sapiens
tttttttaaatagaaaatgactgt

SEQ ID NO: 30277 - DNA, 24 bp, Homo sapiens
accacgaggagcacctgtatgtca

SEQ ID NO: 30278 - DNA, 24 bp, Homo sapiens
cgaccctttgaggatgccctgaag

SEQ ID NO: 30279 - DNA, 24 bp, Homo sapiens
gctcagtggcggcaggcgtgacag

SEQ ID NO: 30280 - DNA, 24 bp, Homo sapiens
tgatgccaggaatgctgatgccag

SEQ ID NO: 30281 - DNA, 24 bp, Homo sapiens
cgccaccaccactcacacagatac

SEQ ID NO: 30282 - DNA, 25 bp, Homo sapiens
ccatgagtcagagaccaccagctat

SEQ ID NO: 30283 - DNA, 23 bp, Homo sapiens
ccgcaataaggtcgtcaaggtga

SEQ ID NO: 30284 - DNA, 25 bp, Homo sapiens
cctggataatgtcatcatgtggtgg

SEQ ID NO: 30285 - DNA, 25 bp, Homo sapiens
ggttcagcagtattcaacatcctct

SEQ ID NO: 30286 - DNA, 25 bp, Homo sapiens
gttctggagactgggaagtccaaga

SEQ ID NO: 30287 - DNA, 25 bp, Homo sapiens
ttataaagaaaagaagtttatttgg

SEQ ID NO: 30288 - DNA, 24 bp, Homo sapiens
cagggctgaaggctgggctgaccc

SEQ ID NO: 30289 - DNA, 24 bp, Homo sapiens
acagggctgaaggctgggctgacc

SEQ ID NO: 30290 - DNA, 24 bp, Homo sapiens
cacagggctgaaggctgggctgac

SEQ ID NO: 30291 - DNA, 24 bp, Homo sapiens
attctaaatcggtaggtattattt

SEQ ID NO: 30292 - DNA, 24 bp, Homo sapiens
aattctaaatcggtaggtattatt

SEQ ID NO: 30293 - DNA, 24 bp, Homo sapiens
aaattctaaatcggtaggtattat

SEQ ID NO: 30294 - DNA, 24 bp, Homo sapiens
aattagtggagtctgtatttagaa

SEQ ID NO: 30295 - DNA, 24 bp, Homo sapiens
aaattagtggagtctgtatttaga

SEQ ID NO: 30296 - DNA, 24 bp, Homo sapiens
gaaattagtggagtctgtatttag

SEQ ID NO: 30297 - DNA, 24 bp, Homo sapiens
gacaaagatcagtaagttttaatt

SEQ ID NO: 30298 - DNA, 24 bp, Homo sapiens
ggacaaagatcagtaagttttaat

SEQ ID NO: 30299 - DNA, 24 bp, Homo sapiens
tggacaaagatcagtaagttttaa

SEQ ID NO: 30300 - DNA, 24 bp, Homo sapiens
ttttattgcagaagctccttcagc

SEQ ID NO: 30301 - DNA, 24 bp, Homo sapiens
tttttattgcagaagctccttcag

SEQ ID NO: 30302 - DNA, 24 bp, Homo sapiens
atttttattgcagaagctccttca

SEQ ID NO: 30303 - DNA, 25 bp, Homo sapiens
ttcttggattccttctgtgttctgg

SEQ ID NO: 30304 - DNA, 25 bp, Homo sapiens
tcacgaccatgatgggtacatttcc

SEQ ID NO: 30305 - DNA, 24 bp, Homo sapiens
gactttgaaagtatagctgccaat

SEQ ID NO: 30306 - DNA, 24 bp, Homo sapiens
aagcactgcaggtaagctgcaaat

SEQ ID NO: 30307 - DNA, 24 bp, Homo sapiens
gaagcactgcaggtaagctgcaaa

SEQ ID NO: 30308 - DNA, 24 bp, Homo sapiens
ggaagcactgcaggtaagctgcaa

SEQ ID NO: 30309 - DNA, 24 bp, Homo sapiens
aattcttacagcaaaatggaaata

SEQ ID NO: 30310 - DNA, 24 bp, Homo sapiens
taattcttacagcaaaatggaaat

SEQ ID NO: 30311 - DNA, 24 bp, Homo sapiens
ttaattcttacagcaaaatggaaa

SEQ ID NO: 30312 - DNA, 24 bp, Homo sapiens
aattatttgaggtaaggcaaaaaa

SEQ ID NO: 30313 - DNA, 24 bp, Homo sapiens
aaattatttgaggtaaggcaaaaa

SEQ ID NO: 30314 - DNA, 24 bp, Homo sapiens
aaaattatttgaggtaaggcaaaa

SEQ ID NO: 30315 - DNA, 23 bp, Homo sapiens
cagcagctccagcagcagcaatt

SEQ ID NO: 30316 - DNA, 23 bp, Homo sapiens
cagcagttactgcagctccagca

SEQ ID NO: 30317 - DNA, 24 bp, Homo sapiens
agcaacagcagcagcagctccagc

SEQ ID NO: 30318 - DNA, 24 bp, Homo sapiens
cagcaacagcagcagcagctccag

SEQ ID NO: 30319 - DNA, 24 bp, Homo sapiens
ccagcaacagcagcagcagctcca

SEQ ID NO: 30320 - DNA, 23 bp, Homo sapiens
gctcgcacctgaggcagtccctg

SEQ ID NO: 30321 - DNA, 23 bp, Homo sapiens
atgaggctgcgggtgcggcttct

SEQ ID NO: 30322 - DNA, 23 bp, Homo sapiens
ctcagctccggtagtcgccagtc

SEQ ID NO: 30323 - DNA, 23 bp, Homo sapiens
gctctttccccgtttcgcctcag

SEQ ID NO: 30324 - DNA, 25 bp, Homo sapiens
tctattccagagaccgagtggcagg

SEQ ID NO: 30325 - DNA, 23 bp, Homo sapiens
ccgcctgcccgcctccagctctc

SEQ ID NO: 30326 - DNA, 24 bp, Homo sapiens
ccctgccgctgctgacccctttgg

SEQ ID NO: 30327 - DNA, 24 bp, Homo sapiens
cccctgccgctgctgacccctttg

SEQ ID NO: 30328 - DNA, 24 bp, Homo sapiens
ccccctgccgctgctgaccccttt

SEQ ID NO: 30329 - DNA, 23 bp, Homo sapiens
gcactctggattggtgacaggag

SEQ ID NO: 30330 - DNA, 24 bp, Homo sapiens
tgcgtccagccctaagatgattca

SEQ ID NO: 30331 - DNA, 23 bp, Homo sapiens
gcctcaagtgatcctcccgtctc

SEQ ID NO: 30332 - DNA, 23 bp, Homo sapiens
gaccgtcctcaaccaagcgatgc

SEQ ID NO: 30333 - DNA, 23 bp, Homo sapiens
gcctcctcagtcctgatgctgct

SEQ ID NO: 30334 - DNA, 23 bp, Homo sapiens
gcctgctgctcctgcccactgtg

SEQ ID NO: 30335 - DNA, 24 bp, Homo sapiens
tttcaatgttggaccaatctgact

SEQ ID NO: 30336 - DNA, 24 bp, Homo sapiens
atttcaatgttggaccaatctgac

SEQ ID NO: 30337 - DNA, 24 bp, Homo sapiens
gatttcaatgttggaccaatctga

SEQ ID NO: 30338 - DNA, 24 bp, Homo sapiens
acctaattgaggtaatgcggaaat

SEQ ID NO: 30339 - DNA, 24 bp, Homo sapiens
aacctaattgaggtaatgcggaaa

SEQ ID NO: 30340 - DNA, 24 bp, Homo sapiens
aaacctaattgaggtaatgcggaa

SEQ ID NO: 30341 - DNA, 23 bp, Homo sapiens
cagcggctggagagggaaccatg

SEQ ID NO: 30342 - DNA, 23 bp, Homo sapiens
cctcagcagcagacgctctgtcc

SEQ ID NO: 30343 - DNA, 23 bp, Homo sapiens
gggggtttgtgggagttgccttg

SEQ ID NO: 30344 - DNA, 23 bp, Homo sapiens
aagtgattcagccagacggagtt

SEQ ID NO: 30345 - DNA, 25 bp, Homo sapiens
tggaacctgaaggaatggattctga

SEQ ID NO: 30346 - DNA, 23 bp, Homo sapiens
gcaatggtgcgatctcggctcac

SEQ ID NO: 30347 - DNA, 25 bp, Homo sapiens
aagaagaccaagacccatcatgccc

SEQ ID NO: 30348 - DNA, 25 bp, Homo sapiens
ggaacagtaccttggcttggctctt

SEQ ID NO: 30349 - DNA, 25 bp, Homo sapiens
ccaagaagaggaagaagaccaaggc

SEQ ID NO: 30350 - DNA, 24 bp, Homo sapiens
agacactggagagtgactgcacca

SEQ ID NO: 30351 - DNA, 24 bp, Homo sapiens
aagacactggagagtgactgcacc

SEQ ID NO: 30352 - DNA, 24 bp, Homo sapiens
gaagacactggagagtgactgcac

SEQ ID NO: 30353 - DNA, 23 bp, Homo sapiens
acagcacagccatcaagccacag

SEQ ID NO: 30354 - DNA, 25 bp, Homo sapiens
ccttggatcaacagctttttctccg

SEQ ID NO: 30355 - DNA, 24 bp, Homo sapiens
tcctcggtgggccaactatgtcaa

SEQ ID NO: 30356 - DNA, 24 bp, Homo sapiens
agtttccactgcccacagcccagc

SEQ ID NO: 30357 - DNA, 24 bp, Homo sapiens
acctctgagggtgccgatgagccc

SEQ ID NO: 30358 - DNA, 23 bp, Homo sapiens
agaccaccagcctctcctctctg

SEQ ID NO: 30359 - DNA, 23 bp, Homo sapiens
ccagatggttcactgtccaggcg

SEQ ID NO: 30360 - DNA, 24 bp, Homo sapiens
tcctcctcggtacacatgctgtcc

SEQ ID NO: 30361 - DNA, 25 bp, Homo sapiens
tgccttctcttgcttcagattcaca

SEQ ID NO: 30362 - DNA, 25 bp, Homo sapiens
gcctcagacactcatggattatcac

SEQ ID NO: 30363 - DNA, 23 bp, Homo sapiens
ctctcctccgcaccgcacagact

SEQ ID NO: 30364 - DNA, 25 bp, Homo sapiens
gggtttggctcaggacactacacag

SEQ ID NO: 30365 - DNA, 24 bp, Homo sapiens
gcctatgatctctccgcagtggtc

SEQ ID NO: 30366 - DNA, 25 bp, Homo sapiens
agggacatgctctcctctcttgaca

SEQ ID NO: 30367 - DNA, 23 bp, Homo sapiens
ctgctgctgctgtgctggtgaag

SEQ ID NO: 30368 - DNA, 23 bp, Homo sapiens
aggttctgccaggtctcggagga

SEQ ID NO: 30369 - DNA, 23 bp, Homo sapiens
gcagcagtacagagaagcgagcc

SEQ ID NO: 30370 - DNA, 23 bp, Homo sapiens
gtggaggtggtgctgcttcatgg

SEQ ID NO: 30371 - DNA, 23 bp, Homo sapiens
cgaggtgctcccactcaaccagg

SEQ ID NO: 30372 - DNA, 25 bp, Homo sapiens
caatgtcacagtcctggctggtctc

SEQ ID NO: 30373 - DNA, 24 bp, Homo sapiens
gagagcagcagccatggccctacg

SEQ ID NO: 30374 - DNA, 24 bp, Homo sapiens
ggagagcagcagccatggccctac

SEQ ID NO: 30375 - DNA, 24 bp, Homo sapiens
tggagagcagcagccatggcccta

SEQ ID NO: 30376 - DNA, 23 bp, Homo sapiens
cttcaatggcgagcagcgtggac

SEQ ID NO: 30377 - DNA, 23 bp, Homo sapiens
tggattaggcaggcagaggcagt

SEQ ID NO: 30378 - DNA, 25 bp, Homo sapiens
acctgtgggtagacaacatccctct

SEQ ID NO: 30379 - DNA, 24 bp, Homo sapiens
cgctcaggctatctccaaaggtgc

SEQ ID NO: 30380 - DNA, 23 bp, Homo sapiens
gtgacagtgacggcagtgtggtg

SEQ ID NO: 30381 - DNA, 25 bp, Homo sapiens
gccagcaactacgaggtgataatga

SEQ ID NO: 30382 - DNA, 24 bp, Homo sapiens
gagcatggcggctttgtcacctat

SEQ ID NO: 30383 - DNA, 24 bp, Homo sapiens
tgagcatggcggctttgtcaccta

SEQ ID NO: 30384 - DNA, 24 bp, Homo sapiens
gtgagcatggcggctttgtcacct

SEQ ID NO: 30385 - DNA, 23 bp, Homo sapiens
gccacaaggatgccgtcacctgt

SEQ ID NO: 30386 - DNA, 23 bp, Homo sapiens
ccttcgggacacctgcttgcttc

SEQ ID NO: 30387 - DNA, 23 bp, Homo sapiens
acagccacagtgaggagtgtcca

SEQ ID NO: 30388 - DNA, 23 bp, Homo sapiens
ggcagaggcaggagtgtggagtc

SEQ ID NO: 30389 - DNA, 23 bp, Homo sapiens
cactgactagcacgctggagcac

SEQ ID NO: 30390 - DNA, 24 bp, Homo sapiens
agcggttgacactgacagaagaca

SEQ ID NO: 30391 - DNA, 24 bp, Homo sapiens
atgacccagtggtaagttatgcag

SEQ ID NO: 30392 - DNA, 24 bp, Homo sapiens
tatgacccagtggtaagttatgca

SEQ ID NO: 30393 - DNA, 24 bp, Homo sapiens
gtatgacccagtggtaagttatgc

SEQ ID NO: 30394 - DNA, 24 bp, Homo sapiens
agaagaactggaaaatataactga

SEQ ID NO: 30395 - DNA, 24 bp, Homo sapiens
gagaagaactggaaaatataactg

SEQ ID NO: 30396 - DNA, 24 bp, Homo sapiens
ggagaagaactggaaaatataact

SEQ ID NO: 30397 - DNA, 25 bp, Homo sapiens
gattccacgaacaactgaactagca

SEQ ID NO: 30398 - DNA, 25 bp, Homo sapiens
aacagaccaatccacccaagaacct

SEQ ID NO: 30399 - DNA, 25 bp, Homo sapiens
agtcaagaggaactacagaccactc

SEQ ID NO: 30400 - DNA, 24 bp, Homo sapiens
cctgaacctacatggacaacaccg

SEQ ID NO: 30401 - DNA, 23 bp, Homo sapiens
gcccaaaccgccaagaaccaaac

SEQ ID NO: 30402 - DNA, 23 bp, Homo sapiens
caagggcaacactggctccaagt

SEQ ID NO: 30403 - DNA, 24 bp, Homo sapiens
cctgcctctggagaagaactggaa

SEQ ID NO: 30404 - DNA, 24 bp, Homo sapiens
tccctgctccattactgactctgt

SEQ ID NO: 30405 - DNA, 23 bp, Homo sapiens
aatgccaccagcccaccacagaa

SEQ ID NO: 30406 - DNA, 24 bp, Homo sapiens
tccctgctccattactgactctgt

SEQ ID NO: 30407 - DNA, 23 bp, Homo sapiens
aatgccaccagcccaccacagaa

SEQ ID NO: 30408 - DNA, 23 bp, Homo sapiens
ctcactgtggtcaccgtggaagg

SEQ ID NO: 30409 - DNA, 25 bp, Homo sapiens
tgggtcattcagtgggaagaacaag

SEQ ID NO: 30410 - DNA, 23 bp, Homo sapiens
cctcactgtggtcaccgtggaag

SEQ ID NO: 30411 - DNA, 23 bp, Homo sapiens
aatgccaccagcccaccacagaa

SEQ ID NO: 30412 - DNA, 25 bp, Homo sapiens
gctggatcttacaagtgtgcctgct

SEQ ID NO: 30413 - DNA, 25 bp, Homo sapiens
ggaagtccaagatcaaggcgtcaga

SEQ ID NO: 30414 - DNA, 24 bp, Homo sapiens
gcttatcaacggacgccatgctaa

SEQ ID NO: 30415 - DNA, 23 bp, Homo sapiens
gcccagccctgcctctatctcag

SEQ ID NO: 30416 - DNA, 25 bp, Homo sapiens
tccatgaagcctacaatgcacattc

SEQ ID NO: 30417 - DNA, 23 bp, Homo sapiens
tgtacctcccctgaatctgcctg

SEQ ID NO: 30418 - DNA, 23 bp, Homo sapiens
tatttcgagagtcaaaatgtgga

SEQ ID NO: 30419 - DNA, 23 bp, Homo sapiens
aggcaagaaggtgatcgaactgg

SEQ ID NO: 30420 - DNA, 23 bp, Homo sapiens
ggacaggcatcgtggggatcttg

SEQ ID NO: 30421 - DNA, 24 bp, Homo sapiens
catctgctgacttgaagggcggtt

SEQ ID NO: 30422 - DNA, 24 bp, Homo sapiens
atgacgcctgagcagagaaggtcc

SEQ ID NO: 30423 - DNA, 24 bp, Homo sapiens
gctggtgggctgtttgtgatggat

SEQ ID NO: 30424 - DNA, 24 bp, Homo sapiens
atgacgcctgagcagagaaggtcc

SEQ ID NO: 30425 - DNA, 24 bp, Homo sapiens
gctggtgggctgtttgtgatggat

SEQ ID NO: 30426 - DNA, 24 bp, Homo sapiens
tgtggtggcagcctggagatcatc

SEQ ID NO: 30427 - DNA, 24 bp, Homo sapiens
aatggaatcctgtaagtaagaagt

SEQ ID NO: 30428 - DNA, 24 bp, Homo sapiens
caatggaatcctgtaagtaagaag

SEQ ID NO: 30429 - DNA, 24 bp, Homo sapiens
gcaatggaatcctgtaagtaagaa

SEQ ID NO: 30430 - DNA, 24 bp, Homo sapiens
gaaagaatgagactggtaataaca

SEQ ID NO: 30431 - DNA, 24 bp, Homo sapiens
ggaaagaatgagactggtaataac

SEQ ID NO: 30432 - DNA, 24 bp, Homo sapiens
tggaaagaatgagactggtaataa

SEQ ID NO: 30433 - DNA, 24 bp, Homo sapiens
tcgtgtgactgagactctgtggtt

SEQ ID NO: 30434 - DNA, 23 bp, Homo sapiens
agcagcaggaacagcagcatcag

SEQ ID NO: 30435 - DNA, 24 bp, Homo sapiens
gcaagccagcctcagagcactatg

SEQ ID NO: 30436 - DNA, 24 bp, Homo sapiens
ttgtagttaaggttagtatttacg

SEQ ID NO: 30437 - DNA, 24 bp, Homo sapiens
cttgtagttaaggttagtatttac

SEQ ID NO: 30438 - DNA, 24 bp, Homo sapiens
tcttgtagttaaggttagtattta

SEQ ID NO: 30439 - DNA, 24 bp, Homo sapiens
ttataattttggtatgtatttcct

SEQ ID NO: 30440 - DNA, 24 bp, Homo sapiens
cttataattttggtatgtatttcc

SEQ ID NO: 30441 - DNA, 24 bp, Homo sapiens
acttataattttggtatgtatttc

SEQ ID NO: 30442 - DNA, 24 bp, Homo sapiens
ttgttaaacaaaaagcatttggtg

SEQ ID NO: 30443 - DNA, 24 bp, Homo sapiens
attgttaaacaaaaagcatttggt

SEQ ID NO: 30444 - DNA, 24 bp, Homo sapiens
aattgttaaacaaaaagcatttgg

SEQ ID NO: 30445 - DNA, 24 bp, Homo sapiens
caggaaactcggtcatcagctggc

SEQ ID NO: 30446 - DNA, 24 bp, Homo sapiens
tcaggaaactcggtcatcagctgg

SEQ ID NO: 30447 - DNA, 24 bp, Homo sapiens
atcaggaaactcggtcatcagctg

SEQ ID NO: 30448 - DNA, 24 bp, Homo sapiens
ttttcaaacaggtttcctttctcc

SEQ ID NO: 30449 - DNA, 24 bp, Homo sapiens
cttttcaaacaggtttcctttctc

SEQ ID NO: 30450 - DNA, 24 bp, Homo sapiens
ccttttcaaacaggtttcctttct

SEQ ID NO: 30451 - DNA, 23 bp, Homo sapiens
ccgagtgtggctcttctggtgtt

SEQ ID NO: 30452 - DNA, 23 bp, Homo sapiens
cggacttcaggcggatctcgtgg

SEQ ID NO: 30453 - DNA, 23 bp, Homo sapiens
ccatcttgctccctctcccaggc

SEQ ID NO: 30454 - DNA, 23 bp, Homo sapiens
ctgctgctgctgcgaggtgctga

SEQ ID NO: 30455 - DNA, 24 bp, Homo sapiens
tgagtcctacacaagctgcatggt

SEQ ID NO: 30456 - DNA, 24 bp, Homo sapiens
caacagtacgtgctcctcctgctg

SEQ ID NO: 30457 - DNA, 23 bp, Homo sapiens
ctgctgctgctgcgaggtgctga

SEQ ID NO: 30458 - DNA, 23 bp, Homo sapiens
cggaggaaagcctgcactcactg

SEQ ID NO: 30459 - DNA, 23 bp, Homo sapiens
aggctgcgttacccggactccac

SEQ ID NO: 30460 - DNA, 24 bp, Homo sapiens
tgagtcctacacaagctgcatggt

SEQ ID NO: 30461 - DNA, 23 bp, Homo sapiens
ctgctgctgctgcgaggtgctga

SEQ ID NO: 30462 - DNA, 23 bp, Homo sapiens
tctgggaggtgacggaggaaagc

SEQ ID NO: 30463 - DNA, 23 bp, Homo sapiens
aggatgagtgggtgctggtgtca

SEQ ID NO: 30464 - DNA, 23 bp, Homo sapiens
cccagcttctgaagacagtgccc

SEQ ID NO: 30465 - DNA, 24 bp, Homo sapiens
accctctcaaccctctgtgtcctg

SEQ ID NO: 30466 - DNA, 23 bp, Homo sapiens
cctcttgcaggaccacatccgag

SEQ ID NO: 30467 - DNA, 23 bp, Homo sapiens
atgtggtggtggtttcagtggct

SEQ ID NO: 30468 - DNA, 25 bp, Homo sapiens
agggcaagtccttcattctggattt

SEQ ID NO: 30469 - DNA, 24 bp, Homo sapiens
tatcaaagagtgtaagtctaaaag

SEQ ID NO: 30470 - DNA, 24 bp, Homo sapiens
ttatcaaagagtgtaagtctaaaa

SEQ ID NO: 30471 - DNA, 24 bp, Homo sapiens
tttatcaaagagtgtaagtctaaa

SEQ ID NO: 30472 - DNA, 24 bp, Homo sapiens
ttaaaatacaaaattggactttca

SEQ ID NO: 30473 - DNA, 24 bp, Homo sapiens
cttaaaatacaaaattggactttc

SEQ ID NO: 30474 - DNA, 24 bp, Homo sapiens
tcttaaaatacaaaattggacttt

SEQ ID NO: 30475 - DNA, 24 bp, Homo sapiens
tgtatcggtgtattacaatgtatg

SEQ ID NO: 30476 - DNA, 23 bp, Homo sapiens
cactcccagtacctggtatgcat

SEQ ID NO: 30477 - DNA, 23 bp, Homo sapiens
atttttctgcatagttggcacgc

SEQ ID NO: 30478 - DNA, 24 bp, Homo sapiens
cctgcctccagaaaatgatgcggt

SEQ ID NO: 30479 - DNA, 24 bp, Homo sapiens
gcctgcctccagaaaatgatgcgg

SEQ ID NO: 30480 - DNA, 24 bp, Homo sapiens
agcctgcctccagaaaatgatgcg

SEQ ID NO: 30481 - DNA, 24 bp, Homo sapiens
gagatgaaaaggaaagtgcaagaa

SEQ ID NO: 30482 - DNA, 24 bp, Homo sapiens
agagatgaaaaggaaagtgcaaga

SEQ ID NO: 30483 - DNA, 24 bp, Homo sapiens
cagagatgaaaaggaaagtgcaag

SEQ ID NO: 30484 - DNA, 25 bp, Homo sapiens
tgatgaacaagaacagagaatcgcc

SEQ ID NO: 30485 - DNA, 23 bp, Homo sapiens
attactggcaacaagggctcggc

SEQ ID NO: 30486 - DNA, 23 bp, Homo sapiens
aggcgggcggatcacgagatatt

SEQ ID NO: 30487 - DNA, 25 bp, Homo sapiens
acacgaatgccaacagtcaggacaa

SEQ ID NO: 30488 - DNA, 23 bp, Homo sapiens
tgagacaagcagccagcagcagc

SEQ ID NO: 30489 - DNA, 25 bp, Homo sapiens
aagccattcagtgtcctcagtcaac

SEQ ID NO: 30490 - DNA, 25 bp, Homo sapiens
caaccttggacacagaactgacacc

SEQ ID NO: 30491 - DNA, 23 bp, Homo sapiens
gttgtgctctggctcctgggctg

SEQ ID NO: 30492 - DNA, 25 bp, Homo sapiens
aacgccttctccatctacatcctca

SEQ ID NO: 30493 - DNA, 24 bp, Homo sapiens
tgatgagcatggaaatacaattct

SEQ ID NO: 30494 - DNA, 24 bp, Homo sapiens
gtgatgagcatggaaatacaattc

SEQ ID NO: 30495 - DNA, 24 bp, Homo sapiens
agtgatgagcatggaaatacaatt

SEQ ID NO: 30496 - DNA, 24 bp, Homo sapiens
ataataaaaaggtaagtttctttg

SEQ ID NO: 30497 - DNA, 24 bp, Homo sapiens
tataataaaaaggtaagtttcttt

SEQ ID NO: 30498 - DNA, 24 bp, Homo sapiens
ctataataaaaaggtaagtttctt

SEQ ID NO: 30499 - DNA, 24 bp, Homo sapiens
taaaaattcaggtttttgaatgtg

SEQ ID NO: 30500 - DNA, 24 bp, Homo sapiens
ataaaaattcaggtttttgaatgt

SEQ ID NO: 30501 - DNA, 24 bp, Homo sapiens
cataaaaattcaggtttttgaatg

SEQ ID NO: 30502 - DNA, 24 bp, Homo sapiens
gtataagcaatgtaagtgttaaat

SEQ ID NO: 30503 - DNA, 24 bp, Homo sapiens
agtataagcaatgtaagtgttaaa

SEQ ID NO: 30504 - DNA, 24 bp, Homo sapiens
aagtataagcaatgtaagtgttaa

SEQ ID NO: 30505 - DNA, 24 bp, Homo sapiens
aatcactaaatagatatccagtgg

SEQ ID NO: 30506 - DNA, 24 bp, Homo sapiens
gaatcactaaatagatatccagtg

SEQ ID NO: 30507 - DNA, 24 bp, Homo sapiens
tgaatcactaaatagatatccagt

SEQ ID NO: 30508 - DNA, 24 bp, Homo sapiens
aatgaagatgggtatgtatttgct

SEQ ID NO: 30509 - DNA, 24 bp, Homo sapiens
caatgaagatgggtatgtatttgc

SEQ ID NO: 30510 - DNA, 24 bp, Homo sapiens
gcaatgaagatgggtatgtatttg

SEQ ID NO: 30511 - DNA, 24 bp, Homo sapiens
tgatattgaaggaaaaggtcactt

SEQ ID NO: 30512 - DNA, 24 bp, Homo sapiens
ttgatattgaaggaaaaggtcact

SEQ ID NO: 30513 - DNA, 24 bp, Homo sapiens
attgatattgaaggaaaaggtcac

SEQ ID NO: 30514 - DNA, 24 bp, Homo sapiens
ttgttttaaagcatacgatatcaa

SEQ ID NO: 30515 - DNA, 24 bp, Homo sapiens
tttgttttaaagcatacgatatca

SEQ ID NO: 30516 - DNA, 24 bp, Homo sapiens
ttttgttttaaagcatacgatatc

SEQ ID NO: 30517 - DNA, 23 bp, Homo sapiens
cgagcaccgtcacctccagccag

SEQ ID NO: 30518 - DNA, 23 bp, Homo sapiens
ccttccaaccagccacaagtacc

SEQ ID NO: 30519 - DNA, 24 bp, Homo sapiens
tgggcagcagcaacctcactaatg

SEQ ID NO: 30520 - DNA, 24 bp, Homo sapiens
aagaaattctggtaagatgatttg

SEQ ID NO: 30521 - DNA, 24 bp, Homo sapiens
caagaaattctggtaagatgattt

SEQ ID NO: 30522 - DNA, 24 bp, Homo sapiens
acaagaaattctggtaagatgatt

SEQ ID NO: 30523 - DNA, 23 bp, Homo sapiens
cactcagcagcagcagcagcaga

SEQ ID NO: 30524 - DNA, 25 bp, Homo sapiens
gaatcaccaacaccagcagcagatg

SEQ ID NO: 30525 - DNA, 23 bp, Homo sapiens
cctgccgtcagttccacaccagt

SEQ ID NO: 30526 - DNA, 24 bp, Homo sapiens
ttgaaaaaaaagtaagacctttag

SEQ ID NO: 30527 - DNA, 24 bp, Homo sapiens
attgaaaaaaaagtaagaccttta

SEQ ID NO: 30528 - DNA, 24 bp, Homo sapiens
gattgaaaaaaaagtaagaccttt

SEQ ID NO: 30529 - DNA, 24 bp, Homo sapiens
ggaaggacccacaccaccaccaga

SEQ ID NO: 30530 - DNA, 24 bp, Homo sapiens
aagcgtatctcaagacagcagcgg

SEQ ID NO: 30531 - DNA, 24 bp, Homo sapiens
gctaccttgtgttcatcggctgct

SEQ ID NO: 30532 - DNA, 24 bp, Homo sapiens
acccattcaaggaaaatcaagaag

SEQ ID NO: 30533 - DNA, 24 bp, Homo sapiens
aacccattcaaggaaaatcaagaa

SEQ ID NO: 30534 - DNA, 24 bp, Homo sapiens
aaacccattcaaggaaaatcaaga

SEQ ID NO: 30535 - DNA, 23 bp, Homo sapiens
gtacctcttctaccgacagcagc

SEQ ID NO: 30536 - DNA, 25 bp, Homo sapiens
cctctcggacaactacagctacctc

SEQ ID NO: 30537 - DNA, 23 bp, Homo sapiens
ctggctgtggctgtggacccttc

SEQ ID NO: 30538 - DNA, 24 bp, Homo sapiens
tctggccacagggtggtatgtctc

SEQ ID NO: 30539 - DNA, 24 bp, Homo sapiens
atctggccacagggtggtatgtct

SEQ ID NO: 30540 - DNA, 24 bp, Homo sapiens
tatctggccacagggtggtatgtc

SEQ ID NO: 30541 - DNA, 25 bp, Homo sapiens
gttcctcaagaagagcacagtgacc

SEQ ID NO: 30542 - DNA, 24 bp, Homo sapiens
agtgggaaagtcaccagaagtcca

SEQ ID NO: 30543 - DNA, 24 bp, Homo sapiens
gaagacactgaaaatgttgaggct

SEQ ID NO: 30544 - DNA, 24 bp, Homo sapiens
ccgcaccttgtcatgtaccatcaa

SEQ ID NO: 30545 - DNA, 24 bp, Homo sapiens
accccttgaagaggggaggggcct

SEQ ID NO: 30546 - DNA, 24 bp, Homo sapiens
ctacaacctcctccaagccgaagc

SEQ ID NO: 30547 - DNA, 24 bp, Homo sapiens
ggagaaggaggaggaggaagtcgc

SEQ ID NO: 30548 - DNA, 23 bp, Homo sapiens
tccgaggctcagtccgtggcatc

SEQ ID NO: 30549 - DNA, 23 bp, Homo sapiens
cctccctctttgtgccccacagg

SEQ ID NO: 30550 - DNA, 23 bp, Homo sapiens
gctgccgcccacccctcgtcttc

SEQ ID NO: 30551 - DNA, 23 bp, Homo sapiens
acctcctggggcccatcatgaat

SEQ ID NO: 30552 - DNA, 24 bp, Homo sapiens
ttctcttaaagctattggcttcta

SEQ ID NO: 30553 - DNA, 24 bp, Homo sapiens
cttctcttaaagctattggcttct

SEQ ID NO: 30554 - DNA, 24 bp, Homo sapiens
ccttctcttaaagctattggcttc

SEQ ID NO: 30555 - DNA, 24 bp, Homo sapiens
gatcacttcaaaacattacaaaca

SEQ ID NO: 30556 - DNA, 24 bp, Homo sapiens
ggatcacttcaaaacattacaaac

SEQ ID NO: 30557 - DNA, 24 bp, Homo sapiens
aggatcacttcaaaacattacaaa

SEQ ID NO: 30558 - DNA, 25 bp, Homo sapiens
cccaggctttcttaacaggcactct

SEQ ID NO: 30559 - DNA, 25 bp, Homo sapiens
ccatcgctcaagcctctgtcatcat

SEQ ID NO: 30560 - DNA, 25 bp, Homo sapiens
gcaagacctactcaaggcactcaag

SEQ ID NO: 30561 - DNA, 24 bp, Homo sapiens
ccatgttgtaggttttggaaaagc

SEQ ID NO: 30562 - DNA, 24 bp, Homo sapiens
accatgttgtaggttttggaaaag

SEQ ID NO: 30563 - DNA, 24 bp, Homo sapiens
taccatgttgtaggttttggaaaa

SEQ ID NO: 30564 - DNA, 24 bp, Homo sapiens
tggcggcgctggtgatggctgtaa

SEQ ID NO: 30565 - DNA, 24 bp, Homo sapiens
atggcggcgctggtgatggctgta

SEQ ID NO: 30566 - DNA, 24 bp, Homo sapiens
gatggcggcgctggtgatggctgt

SEQ ID NO: 30567 - DNA, 23 bp, Homo sapiens
gcagaatctcaacgaccgcctgg

SEQ ID NO: 30568 - DNA, 23 bp, Homo sapiens
ccgcatctccctgtccttcacca

SEQ ID NO: 30569 - DNA, 25 bp, Homo sapiens
tggctctaaacaacaacagtgtgcg

SEQ ID NO: 30570 - DNA, 24 bp, Homo sapiens
gccgacagacgggtctgggtctgc

SEQ ID NO: 30571 - DNA, 24 bp, Homo sapiens
agccgacagacgggtctgggtctg

SEQ ID NO: 30572 - DNA, 24 bp, Homo sapiens
gagccgacagacgggtctgggtct

SEQ ID NO: 30573 - DNA, 23 bp, Homo sapiens
caggctgaggctgtgtcgggaag

SEQ ID NO: 30574 - DNA, 23 bp, Homo sapiens
cagaatcagcattcctcactggc

SEQ ID NO: 30575 - DNA, 23 bp, Homo sapiens
ggatcagctagccgagggttgga

SEQ ID NO: 30576 - DNA, 24 bp, Homo sapiens
tttcttcaaaggatttaagacgtt

SEQ ID NO: 30577 - DNA, 24 bp, Homo sapiens
ttttcttcaaaggatttaagacgt

SEQ ID NO: 30578 - DNA, 24 bp, Homo sapiens
tttttcttcaaaggatttaagacg

SEQ ID NO: 30579 - DNA, 24 bp, Homo sapiens
tcatcacagacggcaagctctcct

SEQ ID NO: 30580 - DNA, 24 bp, Homo sapiens
tcttcaactatgagtccatcgtgt

SEQ ID NO: 30581 - DNA, 24 bp, Homo sapiens
caggcacacacgccagcagcgggg

SEQ ID NO: 30582 - DNA, 24 bp, Homo sapiens
cctaaaacaaggtatacttgtata

SEQ ID NO: 30583 - DNA, 24 bp, Homo sapiens
tcctaaaacaaggtatacttgtat

SEQ ID NO: 30584 - DNA, 24 bp, Homo sapiens
atcctaaaacaaggtatacttgta

SEQ ID NO: 30585 - DNA, 24 bp, Homo sapiens
tggacaactgggttgtttgctaga

SEQ ID NO: 30586 - DNA, 24 bp, Homo sapiens
gtggacaactgggttgtttgctag

SEQ ID NO: 30587 - DNA, 24 bp, Homo sapiens
ggtggacaactgggttgtttgcta

SEQ ID NO: 30588 - DNA, 25 bp, Homo sapiens
aagaagaactacaacaagaagcagc

SEQ ID NO: 30589 - DNA, 25 bp, Homo sapiens
ggcatttggcaaccctgaagagttt

SEQ ID NO: 30590 - DNA, 23 bp, Homo sapiens
gttgaaaggacaccgcagggacc

SEQ ID NO: 30591 - DNA, 24 bp, Homo sapiens
gtgcagggctggaggccattcagc

SEQ ID NO: 30592 - DNA, 24 bp, Homo sapiens
agtgcagggctggaggccattcag

SEQ ID NO: 30593 - DNA, 24 bp, Homo sapiens
cagtgcagggctggaggccattca

SEQ ID NO: 30594 - DNA, 24 bp, Homo sapiens
acgttctgcgggtacaagaaaatt

SEQ ID NO: 30595 - DNA, 24 bp, Homo sapiens
cacgttctgcgggtacaagaaaat

SEQ ID NO: 30596 - DNA, 24 bp, Homo sapiens
ccacgttctgcgggtacaagaaaa

SEQ ID NO: 30597 - DNA, 24 bp, Homo sapiens
tgtgttcacagaataaagacaatg

SEQ ID NO: 30598 - DNA, 24 bp, Homo sapiens
atgtgttcacagaataaagacaat

SEQ ID NO: 30599 - DNA, 24 bp, Homo sapiens
tatgtgttcacagaataaagacaa

SEQ ID NO: 30600 - DNA, 24 bp, Homo sapiens
ccttgaaaatggtaggtttagata

SEQ ID NO: 30601 - DNA, 24 bp, Homo sapiens
tccttgaaaatggtaggtttagat

SEQ ID NO: 30602 - DNA, 24 bp, Homo sapiens
ttccttgaaaatggtaggtttaga

SEQ ID NO: 30603 - DNA, 24 bp, Homo sapiens
tttgtttataggaagaatctgagt

SEQ ID NO: 30604 - DNA, 24 bp, Homo sapiens
ttttgtttataggaagaatctgag

SEQ ID NO: 30605 - DNA, 24 bp, Homo sapiens
cttttgtttataggaagaatctga

SEQ ID NO: 30606 - DNA, 24 bp, Homo sapiens
aggagatcgcaaagcaggtgaacg

SEQ ID NO: 30607 - DNA, 23 bp, Homo sapiens
gtgctctggctgaggctggtgtg

SEQ ID NO: 30608 - DNA, 23 bp, Homo sapiens
cggtggagatggtggtgattggg

SEQ ID NO: 30609 - DNA, 23 bp, Homo sapiens
aatctcggctcaccacaacctcc

SEQ ID NO: 30610 - DNA, 23 bp, Homo sapiens
cggaagttcaccttgccaggacc

SEQ ID NO: 30611 - DNA, 23 bp, Homo sapiens
aggacaggttggcagggaggcag

SEQ ID NO: 30612 - DNA, 25 bp, Homo sapiens
gctctccaagttgtctgtcctgctc

SEQ ID NO: 30613 - DNA, 24 bp, Homo sapiens
gcaatccaggagtggctgaaggag

SEQ ID NO: 30614 - DNA, 23 bp, Homo sapiens
ggctgctggtgacggcgactgtg

SEQ ID NO: 30615 - DNA, 24 bp, Homo sapiens
cgctccttatcgtgaagaactaca

SEQ ID NO: 30616 - DNA, 23 bp, Homo sapiens
cggtggagatggtggtgattggg

SEQ ID NO: 30617 - DNA, 23 bp, Homo sapiens
gtgctctggctgaggctggtgtg

SEQ ID NO: 30618 - DNA, 23 bp, Homo sapiens
cggtggagatggtggtgattggg

SEQ ID NO: 30619 - DNA, 23 bp, Homo sapiens
tgaagaactacactggggatcgg

SEQ ID NO: 30620 - DNA, 24 bp, Homo sapiens
ttcactgtcctgaagaaggcaggc

SEQ ID NO: 30621 - DNA, 23 bp, Homo sapiens
gcctggaggaacacctgaatgcc

SEQ ID NO: 30622 - DNA, 24 bp, Homo sapiens
gcaatccaggagtggctgaaggag

SEQ ID NO: 30623 - DNA, 25 bp, Homo sapiens
gctctccaagttgtctgtcctgctc

SEQ ID NO: 30624 - DNA, 24 bp, Homo sapiens
tggttgtacaggtaagttatttag

SEQ ID NO: 30625 - DNA, 24 bp, Homo sapiens
ttggttgtacaggtaagttattta

SEQ ID NO: 30626 - DNA, 24 bp, Homo sapiens
tttggttgtacaggtaagttattt

SEQ ID NO: 30627 - DNA, 23 bp, Homo sapiens
ctggaggctgtggaccgcaggaa

SEQ ID NO: 30628 - DNA, 23 bp, Homo sapiens
cagcgtggaggatgtggaggacc

SEQ ID NO: 30629 - DNA, 24 bp, Homo sapiens
gctggtgctccaagacaggacatc

SEQ ID NO: 30630 - DNA, 24 bp, Homo sapiens
cagccacaagggtcctggagtgcc

SEQ ID NO: 30631 - DNA, 24 bp, Homo sapiens
tcagccacaagggtcctggagtgc

SEQ ID NO: 30632 - DNA, 24 bp, Homo sapiens
atcagccacaagggtcctggagtg

SEQ ID NO: 30633 - DNA, 23 bp, Homo sapiens
gctctatgctgtggctgtggctc

SEQ ID NO: 30634 - DNA, 25 bp, Homo sapiens
tgttacacagtgcctcctgaagaca

SEQ ID NO: 30635 - DNA, 23 bp, Homo sapiens
ccctccttcagctctacttccgg

SEQ ID NO: 30636 - DNA, 24 bp, Homo sapiens
tttttatatagagaaaaagaagaa

SEQ ID NO: 30637 - DNA, 24 bp, Homo sapiens
gtttttatatagagaaaaagaaga

SEQ ID NO: 30638 - DNA, 24 bp, Homo sapiens
tgtttttatatagagaaaaagaag

SEQ ID NO: 30639 - DNA, 24 bp, Homo sapiens
tccaaatcatgcttgtgaggaccc

SEQ ID NO: 30640 - DNA, 24 bp, Homo sapiens
ttccaaatcatgcttgtgaggacc

SEQ ID NO: 30641 - DNA, 24 bp, Homo sapiens
tttccaaatcatgcttgtgaggac

SEQ ID NO: 30642 - DNA, 24 bp, Homo sapiens
aaatgatgctggataagtgggaga

SEQ ID NO: 30643 - DNA, 24 bp, Homo sapiens
aaaatgatgctggataagtgggag

SEQ ID NO: 30644 - DNA, 24 bp, Homo sapiens
gaaaatgatgctggataagtggga

SEQ ID NO: 30645 - DNA, 25 bp, Homo sapiens
cgctatcgtgaggtccactatgtcc

SEQ ID NO: 30646 - DNA, 23 bp, Homo sapiens
ctgggctggcgtctcctgctgtg

SEQ ID NO: 30647 - DNA, 23 bp, Homo sapiens
gaggaggacttcctggcggtctc

SEQ ID NO: 30648 - DNA, 24 bp, Homo sapiens
ttgaaacaaagggtggatcttttg

SEQ ID NO: 30649 - DNA, 24 bp, Homo sapiens
tttgaaacaaagggtggatctttt

SEQ ID NO: 30650 - DNA, 24 bp, Homo sapiens
ttttgaaacaaagggtggatcttt

SEQ ID NO: 30651 - DNA, 23 bp, Homo sapiens
tcagtgacataagtgataatctt

SEQ ID NO: 30652 - DNA, 25 bp, Homo sapiens
gataatctcagtaatgatttagata

SEQ ID NO: 30653 - DNA, 25 bp, Homo sapiens
tattgctggtggctgctgtggtatg

SEQ ID NO: 30654 - DNA, 25 bp, Homo sapiens
tttgtcaccttcttcagttgtttcc

SEQ ID NO: 30655 - DNA, 25 bp, Homo sapiens
tcacaacacaatacaatcatggacc

SEQ ID NO: 30656 - DNA, 25 bp, Homo sapiens
ggtgccaatggtgtgatgacaagaa

SEQ ID NO: 30657 - DNA, 25 bp, Homo sapiens
gcagtatgtctgtcaagaactacac

SEQ ID NO: 30658 - DNA, 24 bp, Homo sapiens
gccagtgggatcagagacagcaag

SEQ ID NO: 30659 - DNA, 25 bp, Homo sapiens
gccgtccctttgcttctgttgatgt

SEQ ID NO: 30660 - DNA, 23 bp, Homo sapiens
gcaactgcttcgagaacgacagc

SEQ ID NO: 30661 - DNA, 25 bp, Homo sapiens
tattgctggtggctgctgtggtatg

SEQ ID NO: 30662 - DNA, 24 bp, Homo sapiens
gaaatgaacgtaatgttacagtga

SEQ ID NO: 30663 - DNA, 24 bp, Homo sapiens
ggaaatgaacgtaatgttacagtg

SEQ ID NO: 30664 - DNA, 24 bp, Homo sapiens
aggaaatgaacgtaatgttacagt

SEQ ID NO: 30665 - DNA, 23 bp, Homo sapiens
caggacgccttcaactcccactg

SEQ ID NO: 30666 - DNA, 24 bp, Homo sapiens
cgagggaagagcgagaaggagttt

SEQ ID NO: 30667 - DNA, 23 bp, Homo sapiens
tgtccctcttcatgcggcacctg

SEQ ID NO: 30668 - DNA, 23 bp, Homo sapiens
ggctgtcctactggcattgctcc

SEQ ID NO: 30669 - DNA, 25 bp, Homo sapiens
ggattctacactggaggtggacgga

SEQ ID NO: 30670 - DNA, 23 bp, Homo sapiens
agcccagcctccctccacctaag

SEQ ID NO: 30671 - DNA, 24 bp, Homo sapiens
atttatttcaggtcacctgaaatt

SEQ ID NO: 30672 - DNA, 24 bp, Homo sapiens
tatttatttcaggtcacctgaaat

SEQ ID NO: 30673 - DNA, 24 bp, Homo sapiens
ttatttatttcaggtcacctgaaa

SEQ ID NO: 30674 - DNA, 24 bp, Homo sapiens
ttggaaatcaggtgattcgcaagg

SEQ ID NO: 30675 - DNA, 24 bp, Homo sapiens
gttggaaatcaggtgattcgcaag

SEQ ID NO: 30676 - DNA, 24 bp, Homo sapiens
agttggaaatcaggtgattcgcaa

SEQ ID NO: 30677 - DNA, 24 bp, Homo sapiens
acaaatctgtagttaaagatttca

SEQ ID NO: 30678 - DNA, 24 bp, Homo sapiens
gacaaatctgtagttaaagatttc

SEQ ID NO: 30679 - DNA, 24 bp, Homo sapiens
tgacaaatctgtagttaaagattt

SEQ ID NO: 30680 - DNA, 24 bp, Homo sapiens
tgtaaacaaaggtaagacccattc

SEQ ID NO: 30681 - DNA, 24 bp, Homo sapiens
ttgtaaacaaaggtaagacccatt

SEQ ID NO: 30682 - DNA, 24 bp, Homo sapiens
attgtaaacaaaggtaagacccat

SEQ ID NO: 30683 - DNA, 24 bp, Homo sapiens
tgaaagaccagttttgtttagatt

SEQ ID NO: 30684 - DNA, 24 bp, Homo sapiens
atgaaagaccagttttgtttagat

SEQ ID NO: 30685 - DNA, 24 bp, Homo sapiens
aatgaaagaccagttttgtttaga

SEQ ID NO: 30686 - DNA, 24 bp, Homo sapiens
cactgaagggggcagggactctgc

SEQ ID NO: 30687 - DNA, 24 bp, Homo sapiens
ccactgaagggggcagggactctg

SEQ ID NO: 30688 - DNA, 24 bp, Homo sapiens
tccactgaagggggcagggactct

SEQ ID NO: 30689 - DNA, 24 bp, Homo sapiens
catttagaaaggtataagtctttc

SEQ ID NO: 30690 - DNA, 24 bp, Homo sapiens
gcatttagaaaggtataagtcttt

SEQ ID NO: 30691 - DNA, 24 bp, Homo sapiens
agcatttagaaaggtataagtctt

SEQ ID NO: 30692 - DNA, 24 bp, Homo sapiens
tttcattataggagatgctgaaga

SEQ ID NO: 30693 - DNA, 24 bp, Homo sapiens
ttttcattataggagatgctgaag

SEQ ID NO: 30694 - DNA, 24 bp, Homo sapiens
tttttcattataggagatgctgaa

SEQ ID NO: 30695 - DNA, 24 bp, Homo sapiens
cttttaaacaggtcaaagaaagta

SEQ ID NO: 30696 - DNA, 24 bp, Homo sapiens
acttttaaacaggtcaaagaaagt

SEQ ID NO: 30697 - DNA, 24 bp, Homo sapiens
aacttttaaacaggtcaaagaaag

SEQ ID NO: 30698 - DNA, 24 bp, Homo sapiens
gtctcttagagcgttaaaaggatc

SEQ ID NO: 30699 - DNA, 24 bp, Homo sapiens
ggtctcttagagcgttaaaaggat

SEQ ID NO: 30700 - DNA, 24 bp, Homo sapiens
aggtctcttagagcgttaaaagga

SEQ ID NO: 30701 - DNA, 24 bp, Homo sapiens
tttttgaacagatgctgcttgaat

SEQ ID NO: 30702 - DNA, 24 bp, Homo sapiens
atttttgaacagatgctgcttgaa

SEQ ID NO: 30703 - DNA, 24 bp, Homo sapiens
aatttttgaacagatgctgcttga

SEQ ID NO: 30704 - DNA, 25 bp, Homo sapiens
aagatgaagatggaggttggcgact

SEQ ID NO: 30705 - DNA, 25 bp, Homo sapiens
aggaaggtggaccaacatcagtagg

SEQ ID NO: 30706 - DNA, 24 bp, Homo sapiens
gaggcagaggcagaggtgaatgtg

SEQ ID NO: 30707 - DNA, 23 bp, Homo sapiens
gcagcagcaacaccagcaaccaa

SEQ ID NO: 30708 - DNA, 23 bp, Homo sapiens
ttcagcagcagcagcaacagcaa

SEQ ID NO: 30709 - DNA, 23 bp, Homo sapiens
agaggaagaacgagaacggcagc

SEQ ID NO: 30710 - DNA, 23 bp, Homo sapiens
gaagaggaggagggagacagcgg

SEQ ID NO: 30711 - DNA, 24 bp, Homo sapiens
cgtcaacaccaaggatgatccagc

SEQ ID NO: 30712 - DNA, 23 bp, Homo sapiens
aacctttgcctagagtgggagcc

SEQ ID NO: 30713 - DNA, 24 bp, Homo sapiens
tcacatcactgtccaccaccacct

SEQ ID NO: 30714 - DNA, 25 bp, Homo sapiens
accttattgagcgtgattctgttct

SEQ ID NO: 30715 - DNA, 25 bp, Homo sapiens
tctgttggacaactagcctcatctc

SEQ ID NO: 30716 - DNA, 23 bp, Homo sapiens
ggaggtcgcaacattccaatcac

SEQ ID NO: 30717 - DNA, 23 bp, Homo sapiens
caccaccatcaccaccaccatcg

SEQ ID NO: 30718 - DNA, 25 bp, Homo sapiens
atggcagacaactatgatgatgacc

SEQ ID NO: 30719 - DNA, 24 bp, Homo sapiens
ggtcgcaacattccaatcacaggc

SEQ ID NO: 30720 - DNA, 23 bp, Homo sapiens
caccaccatcaccaccaccatcg

SEQ ID NO: 30721 - DNA, 25 bp, Homo sapiens
atggcagacaactatgatgatgacc

SEQ ID NO: 30722 - DNA, 24 bp, Homo sapiens
gttttatacagacaaggtctttac

SEQ ID NO: 30723 - DNA, 24 bp, Homo sapiens
tgttttatacagacaaggtcttta

SEQ ID NO: 30724 - DNA, 24 bp, Homo sapiens
ttgttttatacagacaaggtcttt

SEQ ID NO: 30725 - DNA, 24 bp, Homo sapiens
gatggaaaaaaatcttcaattttg

SEQ ID NO: 30726 - DNA, 24 bp, Homo sapiens
cgatggaaaaaaatcttcaatttt

SEQ ID NO: 30727 - DNA, 24 bp, Homo sapiens
tcgatggaaaaaaatcttcaattt

SEQ ID NO: 30728 - DNA, 24 bp, Homo sapiens
gatggaaaaaagttagtatttttt

SEQ ID NO: 30729 - DNA, 24 bp, Homo sapiens
cgatggaaaaaagttagtattttt

SEQ ID NO: 30730 - DNA, 24 bp, Homo sapiens
tcgatggaaaaaagttagtatttt

SEQ ID NO: 30731 - DNA, 24 bp, Homo sapiens
tgcaagctcaggtaaatactgtac

SEQ ID NO: 30732 - DNA, 24 bp, Homo sapiens
atgcaagctcaggtaaatactgta

SEQ ID NO: 30733 - DNA, 24 bp, Homo sapiens
catgcaagctcaggtaaatactgt

SEQ ID NO: 30734 - DNA, 24 bp, Homo sapiens
aaaatgacaagataagtttcttta

SEQ ID NO: 30735 - DNA, 24 bp, Homo sapiens
gaaaatgacaagataagtttcttt

SEQ ID NO: 30736 - DNA, 24 bp, Homo sapiens
agaaaatgacaagataagtttctt

SEQ ID NO: 30737 - DNA, 24 bp, Homo sapiens
ttattgaaaaggcagtgagaagca

SEQ ID NO: 30738 - DNA, 24 bp, Homo sapiens
gttattgaaaaggcagtgagaagc

SEQ ID NO: 30739 - DNA, 24 bp, Homo sapiens
tgttattgaaaaggcagtgagaag

SEQ ID NO: 30740 - DNA, 25 bp, Homo sapiens
aagtgccaggattacaggtgtgaac

SEQ ID NO: 30741 - DNA, 25 bp, Homo sapiens
aagtgccaggattacaggtgtgaat

SEQ ID NO: 30742 - DNA, 25 bp, Homo sapiens
gcctcccagagacatctttgacttt

SEQ ID NO: 30743 - DNA, 24 bp, Homo sapiens
cgataccagcggcaccttcaatgt

SEQ ID NO: 30744 - DNA, 23 bp, Homo sapiens
cgccttgtccttcaacgccttca

SEQ ID NO: 30745 - DNA, 23 bp, Homo sapiens
cgtggaccaggctctgaaggagt

SEQ ID NO: 30746 - DNA, 24 bp, Homo sapiens
aaaagtggaaggtactccagaatt

SEQ ID NO: 30747 - DNA, 24 bp, Homo sapiens
caaaagtggaaggtactccagaat

SEQ ID NO: 30748 - DNA, 24 bp, Homo sapiens
acaaaagtggaaggtactccagaa

SEQ ID NO: 30749 - DNA, 24 bp, Homo sapiens
aaaaaatacatgtgttgaaaagtc

SEQ ID NO: 30750 - DNA, 24 bp, Homo sapiens
aaaaaaatacatgtgttgaaaagt

SEQ ID NO: 30751 - DNA, 24 bp, Homo sapiens
caaaaaaatacatgtgttgaaaag

SEQ ID NO: 30752 - DNA, 23 bp, Homo sapiens
tgcagcctacatatctcccgtgg

SEQ ID NO: 30753 - DNA, 25 bp, Homo sapiens
atgttgcccaattcagcagataggg

SEQ ID NO: 30754 - DNA, 24 bp, Homo sapiens
gctaaggagaaaaaggcaattaaa

SEQ ID NO: 30755 - DNA, 24 bp, Homo sapiens
ataaattacaggtaaatccactac

SEQ ID NO: 30756 - DNA, 24 bp, Homo sapiens
gataaattacaggtaaatccacta

SEQ ID NO: 30757 - DNA, 24 bp, Homo sapiens
agataaattacaggtaaatccact

SEQ ID NO: 30758 - DNA, 23 bp, Homo sapiens
gcggtggattcagaggaggtcgt

SEQ ID NO: 30759 - DNA, 23 bp, Homo sapiens
gcgtggtggtggcagaggtggta

SEQ ID NO: 30760 - DNA, 24 bp, Homo sapiens
acagaggcagaggaggtcttggtt

SEQ ID NO: 30761 - DNA, 23 bp, Homo sapiens
gagtagcagccaaggttcccaaa

SEQ ID NO: 30762 - DNA, 25 bp, Homo sapiens
agtgtccgaagaagtcaagatgctg

SEQ ID NO: 30763 - DNA, 23 bp, Homo sapiens
gccctttccacggactctgtttc

SEQ ID NO: 30764 - DNA, 24 bp, Homo sapiens
gagaattacaggtccattaatata

SEQ ID NO: 30765 - DNA, 24 bp, Homo sapiens
ggagaattacaggtccattaatat

SEQ ID NO: 30766 - DNA, 24 bp, Homo sapiens
aggagaattacaggtccattaata

SEQ ID NO: 30767 - DNA, 25 bp, Homo sapiens
agagttggaagcaagacatcagaat

SEQ ID NO: 30768 - DNA, 25 bp, Homo sapiens
acacacagcatccacatttgaccca

SEQ ID NO: 30769 - DNA, 25 bp, Homo sapiens
atgaagtctaccaacaacgaacact

SEQ ID NO: 30770 - DNA, 25 bp, Homo sapiens
gctctgccagtcacctctttactct

SEQ ID NO: 30771 - DNA, 23 bp, Homo sapiens
gcgaatgagaaagtggagatgct

SEQ ID NO: 30772 - DNA, 25 bp, Homo sapiens
cagctattggtggaatcttgtgaca

SEQ ID NO: 30773 - DNA, 24 bp, Homo sapiens
agaaatccaagatgctggcccgcc

SEQ ID NO: 30774 - DNA, 24 bp, Homo sapiens
gagaaatccaagatgctggcccgc

SEQ ID NO: 30775 - DNA, 24 bp, Homo sapiens
ggagaaatccaagatgctggcccg

SEQ ID NO: 30776 - DNA, 24 bp, Homo sapiens
gaaagtacttgaaaactggtggtc

SEQ ID NO: 30777 - DNA, 24 bp, Homo sapiens
tgaaagtacttgaaaactggtggt

SEQ ID NO: 30778 - DNA, 24 bp, Homo sapiens
ctgaaagtacttgaaaactggtgg

SEQ ID NO: 30779 - DNA, 24 bp, Homo sapiens
gattaactgagttggcagatatcc

SEQ ID NO: 30780 - DNA, 24 bp, Homo sapiens
ggattaactgagttggcagatatc

SEQ ID NO: 30781 - DNA, 24 bp, Homo sapiens
tggattaactgagttggcagatat

SEQ ID NO: 30782 - DNA, 24 bp, Homo sapiens
ctgttttacagcaagtgaagtctt

SEQ ID NO: 30783 - DNA, 24 bp, Homo sapiens
actgttttacagcaagtgaagtct

SEQ ID NO: 30784 - DNA, 24 bp, Homo sapiens
tactgttttacagcaagtgaagtc

SEQ ID NO: 30785 - DNA, 23 bp, Homo sapiens
gactcgcagagactccaggctgt

SEQ ID NO: 30786 - DNA, 23 bp, Homo sapiens
ggattcccacattctgctatgcc

SEQ ID NO: 30787 - DNA, 23 bp, Homo sapiens
ttcggtgtgctgggcctcgctga

SEQ ID NO: 30788 - DNA, 23 bp, Homo sapiens
ggtgcctggtcctgtgcctggtc

SEQ ID NO: 30789 - DNA, 24 bp, Homo sapiens
cttcagtacaggcttgtctcggcg

SEQ ID NO: 30790 - DNA, 23 bp, Homo sapiens
tgctctcatggctcctctgctgt

SEQ ID NO: 30791 - DNA, 24 bp, Homo sapiens
aagaaaacaaggtaaattaagtgg

SEQ ID NO: 30792 - DNA, 24 bp, Homo sapiens
aaagaaaacaaggtaaattaagtg

SEQ ID NO: 30793 - DNA, 24 bp, Homo sapiens
aaaagaaaacaaggtaaattaagt

SEQ ID NO: 30794 - DNA, 23 bp, Homo sapiens
gacgggatgaggcggcggttgat

SEQ ID NO: 30795 - DNA, 23 bp, Homo sapiens
ccagccatgaacctggcgagcca

SEQ ID NO: 30796 - DNA, 23 bp, Homo sapiens
ccgaccctgagtgcagcctgacc

SEQ ID NO: 30797 - DNA, 23 bp, Homo sapiens
tctggagcataaacaagagcggg

SEQ ID NO: 30798 - DNA, 23 bp, Homo sapiens
atgaggcggcggttgatcccagg

SEQ ID NO: 30799 - DNA, 23 bp, Homo sapiens
ccgaccctgagtgcagcctgacc

SEQ ID NO: 30800 - DNA, 24 bp, Homo sapiens
ctacccagcaggtgagaggggctg

SEQ ID NO: 30801 - DNA, 24 bp, Homo sapiens
tctacccagcaggtgagaggggct

SEQ ID NO: 30802 - DNA, 24 bp, Homo sapiens
ttctacccagcaggtgagaggggc

SEQ ID NO: 30803 - DNA, 24 bp, Homo sapiens
gttcctttcagttcgctttgcacc

SEQ ID NO: 30804 - DNA, 24 bp, Homo sapiens
tgttcctttcagttcgctttgcac

SEQ ID NO: 30805 - DNA, 24 bp, Homo sapiens
ttgttcctttcagttcgctttgca

SEQ ID NO: 30806 - DNA, 25 bp, Homo sapiens
ctggtgaccgtgcttgttactagga

SEQ ID NO: 30807 - DNA, 24 bp, Homo sapiens
tgctatctgtcagtccatctccaa

SEQ ID NO: 30808 - DNA, 25 bp, Homo sapiens
aaagcccatcacgagttatcaaggt

SEQ ID NO: 30809 - DNA, 24 bp, Homo sapiens
tatttggctaggaacatcatttac

SEQ ID NO: 30810 - DNA, 24 bp, Homo sapiens
ttatttggctaggaacatcattta

SEQ ID NO: 30811 - DNA, 24 bp, Homo sapiens
attatttggctaggaacatcattt

SEQ ID NO: 30812 - DNA, 24 bp, Homo sapiens
aaacattttagcaaacttaaacta

SEQ ID NO: 30813 - DNA, 24 bp, Homo sapiens
aaaacattttagcaaacttaaact

SEQ ID NO: 30814 - DNA, 24 bp, Homo sapiens
aaaaacattttagcaaacttaaac

SEQ ID NO: 30815 - DNA, 24 bp, Homo sapiens
ccatgaaacaggtttgatttttct

SEQ ID NO: 30816 - DNA, 24 bp, Homo sapiens
gccatgaaacaggtttgatttttc

SEQ ID NO: 30817 - DNA, 24 bp, Homo sapiens
agccatgaaacaggtttgattttt

SEQ ID NO: 30818 - DNA, 24 bp, Homo sapiens
attcattcaaggtaactcaatacc

SEQ ID NO: 30819 - DNA, 24 bp, Homo sapiens
aattcattcaaggtaactcaatac

SEQ ID NO: 30820 - DNA, 24 bp, Homo sapiens
gaattcattcaaggtaactcaata

SEQ ID NO: 30821 - DNA, 24 bp, Homo sapiens
gtctcaacaagctctctagtgacg

SEQ ID NO: 30822 - DNA, 24 bp, Homo sapiens
tgtctcaacaagctctctagtgac

SEQ ID NO: 30823 - DNA, 24 bp, Homo sapiens
ctgtctcaacaagctctctagtga

SEQ ID NO: 30824 - DNA, 24 bp, Homo sapiens
tataaaagccgtttgttgcctcac

SEQ ID NO: 30825 - DNA, 24 bp, Homo sapiens
ttataaaagccgtttgttgcctca

SEQ ID NO: 30826 - DNA, 24 bp, Homo sapiens
gttataaaagccgtttgttgcctc

SEQ ID NO: 30827 - DNA, 24 bp, Homo sapiens
ccactgcccgacaccactgccctg

SEQ ID NO: 30828 - DNA, 24 bp, Homo sapiens
cgttcgagatcaaggtgtacgaga

SEQ ID NO: 30829 - DNA, 24 bp, Homo sapiens
ccccgcccctggctggctccctga

SEQ ID NO: 30830 - DNA, 24 bp, Homo sapiens
ttgtcattaagtccaatgtaactc

SEQ ID NO: 30831 - DNA, 24 bp, Homo sapiens
tttgtcattaagtccaatgtaact

SEQ ID NO: 30832 - DNA, 24 bp, Homo sapiens
ctttgtcattaagtccaatgtaac

SEQ ID NO: 30833 - DNA, 24 bp, Homo sapiens
aaaatgtccaggtaagatggaatt

SEQ ID NO: 30834 - DNA, 24 bp, Homo sapiens
gaaaatgtccaggtaagatggaat

SEQ ID NO: 30835 - DNA, 24 bp, Homo sapiens
agaaaatgtccaggtaagatggaa

SEQ ID NO: 30836 - DNA, 24 bp, Homo sapiens
aagaaactcaggtaaatataatga

SEQ ID NO: 30837 - DNA, 24 bp, Homo sapiens
aaagaaactcaggtaaatataatg

SEQ ID NO: 30838 - DNA, 24 bp, Homo sapiens
taaagaaactcaggtaaatataat

SEQ ID NO: 30839 - DNA, 25 bp, Homo sapiens
tggctggctgtgctgtctaatccta

SEQ ID NO: 30840 - DNA, 25 bp, Homo sapiens
ggttacagtggagaatgagttgagc

SEQ ID NO: 30841 - DNA, 25 bp, Homo sapiens
cggaagcctcatctacatcattgcc

SEQ ID NO: 30842 - DNA, 25 bp, Homo sapiens
ttcaggagaactcggcatacatctg

SEQ ID NO: 30843 - DNA, 23 bp, Homo sapiens
gctggtgctgcctgtggtcctgc

SEQ ID NO: 30844 - DNA, 23 bp, Homo sapiens
gctgtacgacctcaccctggagt

SEQ ID NO: 30845 - DNA, 24 bp, Homo sapiens
attgagaaagggtcaaagtacatg

SEQ ID NO: 30846 - DNA, 24 bp, Homo sapiens
gattgagaaagggtcaaagtacat

SEQ ID NO: 30847 - DNA, 24 bp, Homo sapiens
tgattgagaaagggtcaaagtaca

SEQ ID NO: 30848 - DNA, 25 bp, Homo sapiens
agccaccaactattacagaagaaga

SEQ ID NO: 30849 - DNA, 25 bp, Homo sapiens
tggcaacagatgatttccttgtaga

SEQ ID NO: 30850 - DNA, 24 bp, Homo sapiens
acagcagccagaagtgacagcatt

SEQ ID NO: 30851 - DNA, 25 bp, Homo sapiens
catcctgctgctgataggttcaagg

SEQ ID NO: 30852 - DNA, 25 bp, Homo sapiens
accagattctgctgacatgagaagc

SEQ ID NO: 30853 - DNA, 24 bp, Homo sapiens
tttcttgttaggttcatgcaaata

SEQ ID NO: 30854 - DNA, 24 bp, Homo sapiens
ctttcttgttaggttcatgcaaat

SEQ ID NO: 30855 - DNA, 24 bp, Homo sapiens
gctttcttgttaggttcatgcaaa

SEQ ID NO: 30856 - DNA, 24 bp, Homo sapiens
tgagcttcttctcgaccaacctgc

SEQ ID NO: 30857 - DNA, 24 bp, Homo sapiens
gccgcaacctcgccttcagcctgg

SEQ ID NO: 30858 - DNA, 24 bp, Homo sapiens
ttcctgcccacgttcatgtactgc

SEQ ID NO: 30859 - DNA, 24 bp, Homo sapiens
gctctgttgtccatcttctcacgc

SEQ ID NO: 30860 - DNA, 24 bp, Homo sapiens
gagccgacgacagcgagttccagg

SEQ ID NO: 30861 - DNA, 24 bp, Homo sapiens
gctgctgcttcctgactggctgaa

SEQ ID NO: 30862 - DNA, 24 bp, Homo sapiens
cgccttcctggtggacacatcgga

SEQ ID NO: 30863 - DNA, 24 bp, Homo sapiens
gctgctgcttcctgactggctgaa

SEQ ID NO: 30864 - DNA, 24 bp, Homo sapiens
atgatccgttctgaggtgctccgc

SEQ ID NO: 30865 - DNA, 24 bp, Homo sapiens
acgatgagagtgtcaggaaggtga

SEQ ID NO: 30866 - DNA, 24 bp, Homo sapiens
gtgcccgtgcctgaggtcctactg

SEQ ID NO: 30867 - DNA, 24 bp, Homo sapiens
ctcatccaccgcttcatcacgctc

SEQ ID NO: 30868 - DNA, 23 bp, Homo sapiens
ctggagcggatgaggtctgtgcg

SEQ ID NO: 30869 - DNA, 23 bp, Homo sapiens
cctacaggtcatcgccgcctacc

SEQ ID NO: 30870 - DNA, 25 bp, Homo sapiens
cgccgagttctttgagtttgtgctt

SEQ ID NO: 30871 - DNA, 25 bp, Homo sapiens
cgccgagttctttgagtttgtgctt

SEQ ID NO: 30872 - DNA, 23 bp, Homo sapiens
cctacaggtcatcgccgcctacc

SEQ ID NO: 30873 - DNA, 23 bp, Homo sapiens
ccacaacacacagcacacggtga

SEQ ID NO: 30874 - DNA, 25 bp, Homo sapiens
ccagcagcccaggagtttgacttac

SEQ ID NO: 30875 - DNA, 25 bp, Homo sapiens
gctcaagctctaggactggaggtgt

SEQ ID NO: 30876 - DNA, 24 bp, Homo sapiens
aaccacaccgccctaactgttgtc

SEQ ID NO: 30877 - DNA, 24 bp, Homo sapiens
cacaattacaggtaagtccttagt

SEQ ID NO: 30878 - DNA, 24 bp, Homo sapiens
acacaattacaggtaagtccttag

SEQ ID NO: 30879 - DNA, 24 bp, Homo sapiens
tacacaattacaggtaagtcctta

SEQ ID NO: 30880 - DNA, 24 bp, Homo sapiens
tagatttcaagaatgaagaggaac

SEQ ID NO: 30881 - DNA, 24 bp, Homo sapiens
ttagatttcaagaatgaagaggaa

SEQ ID NO: 30882 - DNA, 24 bp, Homo sapiens
attagatttcaagaatgaagagga

SEQ ID NO: 30883 - DNA, 24 bp, Homo sapiens
tacagccaatgatttcagcaacgt

SEQ ID NO: 30884 - DNA, 24 bp, Homo sapiens
atacagccaatgatttcagcaacg

SEQ ID NO: 30885 - DNA, 24 bp, Homo sapiens
aatacagccaatgatttcagcaac

SEQ ID NO: 30886 - DNA, 24 bp, Homo sapiens
aaaagaaattgccctcgaattccc

SEQ ID NO: 30887 - DNA, 24 bp, Homo sapiens
aaaaagaaattgccctcgaattcc

SEQ ID NO: 30888 - DNA, 24 bp, Homo sapiens
gaaaaagaaattgccctcgaattc

SEQ ID NO: 30889 - DNA, 25 bp, Homo sapiens
agtaacctcttccacaggcttcaag

SEQ ID NO: 30890 - DNA, 23 bp, Homo sapiens
tgttgcccaggctgctctcaaac

SEQ ID NO: 30891 - DNA, 25 bp, Homo sapiens
cggctagtgcaatttggacgatgag

SEQ ID NO: 30892 - DNA, 24 bp, Homo sapiens
gtccaacaagtccaagaagagcaa

SEQ ID NO: 30893 - DNA, 24 bp, Homo sapiens
gccactgaccatgaagaaggaagg

SEQ ID NO: 30894 - DNA, 24 bp, Homo sapiens
tcagacgacaaccaccaccttatg

SEQ ID NO: 30895 - DNA, 24 bp, Homo sapiens
aggaggagcaggaattcctttcct

SEQ ID NO: 30896 - DNA, 24 bp, Homo sapiens
caggaggagcaggaattcctttcc

SEQ ID NO: 30897 - DNA, 24 bp, Homo sapiens
acaggaggagcaggaattcctttc

SEQ ID NO: 30898 - DNA, 24 bp, Homo sapiens
aaccatcaacggcttcctcagtcc

SEQ ID NO: 30899 - DNA, 25 bp, Homo sapiens
tgttgttatcaaggaggtgccaagc

SEQ ID NO: 30900 - DNA, 25 bp, Homo sapiens
tgatgtgttaatggtggatgtggca

SEQ ID NO: 30901 - DNA, 25 bp, Homo sapiens
cgacaccacagaagaaattagaatg

SEQ ID NO: 30902 - DNA, 25 bp, Homo sapiens
agaatctaaagtacctacccagatg

SEQ ID NO: 30903 - DNA, 25 bp, Homo sapiens
tctacagacacagacgaggacaatg

SEQ ID NO: 30904 - DNA, 24 bp, Homo sapiens
ttatgaggatgggtttcttaatat

SEQ ID NO: 30905 - DNA, 24 bp, Homo sapiens
cttatgaggatgggtttcttaata

SEQ ID NO: 30906 - DNA, 24 bp, Homo sapiens
gcttatgaggatgggtttcttaat

SEQ ID NO: 30907 - DNA, 24 bp, Homo sapiens
gtggtagttggaggcgtcatgtcg

SEQ ID NO: 30908 - DNA, 23 bp, Homo sapiens
ttggcttcaacattgtcttctgg

SEQ ID NO: 30909 - DNA, 23 bp, Homo sapiens
aggtcggctgctgcgggaaatac

SEQ ID NO: 30910 - DNA, 24 bp, Homo sapiens
aaagaatgatggagagaaccagga

SEQ ID NO: 30911 - DNA, 24 bp, Homo sapiens
aaaagaatgatggagagaaccagg

SEQ ID NO: 30912 - DNA, 24 bp, Homo sapiens
aaaaagaatgatggagagaaccag

SEQ ID NO: 30913 - DNA, 23 bp, Homo sapiens
ctgccgtggagaagtggaacctg

SEQ ID NO: 30914 - DNA, 25 bp, Homo sapiens
ctgctctgcttcatgtgctgtacca

SEQ ID NO: 30915 - DNA, 23 bp, Homo sapiens
tccaacacctccaccaccgccat

SEQ ID NO: 30916 - DNA, 24 bp, Homo sapiens
cgaggcactgcatgtcatcaccaa

SEQ ID NO: 30917 - DNA, 24 bp, Homo sapiens
ccagagcagccaacccacccgagt

SEQ ID NO: 30918 - DNA, 24 bp, Homo sapiens
attatcaccaagggcgacagcacc

SEQ ID NO: 30919 - DNA, 25 bp, Homo sapiens
aacagaatacttgctatcttcagag

SEQ ID NO: 30920 - DNA, 24 bp, Homo sapiens
tgacccgtcctatgagatccaact

SEQ ID NO: 30921 - DNA, 25 bp, Homo sapiens
tacgtatgccatggaggtttgctgc

SEQ ID NO: 30922 - DNA, 24 bp, Homo sapiens
ttttgaaatgtatgtgtgctttac

SEQ ID NO: 30923 - DNA, 24 bp, Homo sapiens
attttgaaatgtatgtgtgcttta

SEQ ID NO: 30924 - DNA, 24 bp, Homo sapiens
tattttgaaatgtatgtgtgcttt

SEQ ID NO: 30925 - DNA, 25 bp, Homo sapiens
tcaagcaatcctctcacctcagcct

SEQ ID NO: 30926 - DNA, 25 bp, Homo sapiens
gcagagacaggcaggagtagacacc

SEQ ID NO: 30927 - DNA, 23 bp, Homo sapiens
tccgaccgagaactctgctaagc

SEQ ID NO: 30928 - DNA, 24 bp, Homo sapiens
gcccaagtcctgaaagccctgaat

SEQ ID NO: 30929 - DNA, 23 bp, Homo sapiens
aggtggtggtggagctgatcctg

SEQ ID NO: 30930 - DNA, 23 bp, Homo sapiens
gcaccacgaacgcctttgtatgg

SEQ ID NO: 30931 - DNA, 24 bp, Homo sapiens
actggagtttctgcgatctctgcg

SEQ ID NO: 30932 - DNA, 23 bp, Homo sapiens
gcaccacgaacgcctttgtatgg

SEQ ID NO: 30933 - DNA, 23 bp, Homo sapiens
aggtggtggtggagctgatcctg

SEQ ID NO: 30934 - DNA, 24 bp, Homo sapiens
ccaattcctgacctcgtgatccgc

SEQ ID NO: 30935 - DNA, 23 bp, Homo sapiens
gctgctgtttctcttcgccgacg

SEQ ID NO: 30936 - DNA, 23 bp, Homo sapiens
caggctgcggtgggatttcgttt

SEQ ID NO: 30937 - DNA, 23 bp, Homo sapiens
ctcctcggaccctctgagcatgg

SEQ ID NO: 30938 - DNA, 23 bp, Homo sapiens
gaccagctcgcttcctgccacta

SEQ ID NO: 30939 - DNA, 25 bp, Homo sapiens
gctgcttcttgaggacggatacaat

SEQ ID NO: 30940 - DNA, 24 bp, Homo sapiens
tattttaataggttcgagaacatc

SEQ ID NO: 30941 - DNA, 24 bp, Homo sapiens
ttattttaataggttcgagaacat

SEQ ID NO: 30942 - DNA, 24 bp, Homo sapiens
tttattttaataggttcgagaaca

SEQ ID NO: 30943 - DNA, 24 bp, Homo sapiens
aaataaatcaggtgagtaaagagg

SEQ ID NO: 30944 - DNA, 24 bp, Homo sapiens
taaataaatcaggtgagtaaagag

SEQ ID NO: 30945 - DNA, 24 bp, Homo sapiens
ttaaataaatcaggtgagtaaaga

SEQ ID NO: 30946 - DNA, 24 bp, Homo sapiens
cccgagaggagcttcttcagcctc

SEQ ID NO: 30947 - DNA, 24 bp, Homo sapiens
tacctgcacaacctgctgggcctg

SEQ ID NO: 30948 - DNA, 24 bp, Homo sapiens
aactactgctggctgctggtggag

SEQ ID NO: 30949 - DNA, 23 bp, Homo sapiens
ctgtagcaatcacggaagccttg

SEQ ID NO: 30950 - DNA, 25 bp, Homo sapiens
atgtgtatggtaatgcgaggtgtac

SEQ ID NO: 30951 - DNA, 23 bp, Homo sapiens
cttccacgcacctgaacgagcac

SEQ ID NO: 30952 - DNA, 25 bp, Homo sapiens
gtgatgctggtgaaggtgggagaag

SEQ ID NO: 30953 - DNA, 25 bp, Homo sapiens
ccgacttcctggacaagcatcagat

SEQ ID NO: 30954 - DNA, 25 bp, Homo sapiens
tgggcttcaccttctcctttcctgt

SEQ ID NO: 30955 - DNA, 24 bp, Homo sapiens
ttacatttcagaaccatcaagaaa

SEQ ID NO: 30956 - DNA, 24 bp, Homo sapiens
cttacatttcagaaccatcaagaa

SEQ ID NO: 30957 - DNA, 24 bp, Homo sapiens
acttacatttcagaaccatcaaga

SEQ ID NO: 30958 - DNA, 24 bp, Homo sapiens
ctcttcccgtctcccagcgtggat

SEQ ID NO: 30959 - DNA, 24 bp, Homo sapiens
caccctcgcctgtcacgcctccct

SEQ ID NO: 30960 - DNA, 24 bp, Homo sapiens
cgcctgcagatcccggctagggca

SEQ ID NO: 30961 - DNA, 25 bp, Homo sapiens
accaagagaatgtgtcagccgatgc

SEQ ID NO: 30962 - DNA, 23 bp, Homo sapiens
caggacccacgagaagcggaaac

SEQ ID NO: 30963 - DNA, 23 bp, Homo sapiens
gactccctggtgaacgccgcttg

SEQ ID NO: 30964 - DNA, 23 bp, Homo sapiens
ctggagtgagctgagcagaagtt

SEQ ID NO: 30965 - DNA, 25 bp, Homo sapiens
tcctcagaactagacatcaatgcct

SEQ ID NO: 30966 - DNA, 25 bp, Homo sapiens
gcggcatattcagattcagacctct

SEQ ID NO: 30967 - DNA, 24 bp, Homo sapiens
acagcagcagcaacaacctctaca

SEQ ID NO: 30968 - DNA, 24 bp, Homo sapiens
ggttgaatcgctctgagtctccaa

SEQ ID NO: 30969 - DNA, 23 bp, Homo sapiens
actactcagtccacatcctcagc

SEQ ID NO: 30970 - DNA, 24 bp, Homo sapiens
aaattccagagctttaaagaagtg

SEQ ID NO: 30971 - DNA, 24 bp, Homo sapiens
gaaattccagagctttaaagaagt

SEQ ID NO: 30972 - DNA, 24 bp, Homo sapiens
tgaaattccagagctttaaagaag

SEQ ID NO: 30973 - DNA, 24 bp, Homo sapiens
ggttgaatcgctctgagtctccaa

SEQ ID NO: 30974 - DNA, 25 bp, Homo sapiens
acagcagcagcaacaacctctacat

SEQ ID NO: 30975 - DNA, 25 bp, Homo sapiens
ctactcagtccacatcctcagcgat

SEQ ID NO: 30976 - DNA, 24 bp, Homo sapiens
tgtatttgatggcaactactatta

SEQ ID NO: 30977 - DNA, 24 bp, Homo sapiens
ctgtatttgatggcaactactatt

SEQ ID NO: 30978 - DNA, 24 bp, Homo sapiens
gctgtatttgatggcaactactat

SEQ ID NO: 30979 - DNA, 24 bp, Homo sapiens
aaatggtttagggaaaacttcaga

SEQ ID NO: 30980 - DNA, 24 bp, Homo sapiens
caaatggtttagggaaaacttcag

SEQ ID NO: 30981 - DNA, 24 bp, Homo sapiens
tcaaatggtttagggaaaacttca

SEQ ID NO: 30982 - DNA, 24 bp, Homo sapiens
tttgctttaagaatatgaaagaat

SEQ ID NO: 30983 - DNA, 24 bp, Homo sapiens
ttttgctttaagaatatgaaagaa

SEQ ID NO: 30984 - DNA, 24 bp, Homo sapiens
cttttgctttaagaatatgaaaga

SEQ ID NO: 30985 - DNA, 25 bp, Homo sapiens
gtgaccccaaaatttaaatgaggca

SEQ ID NO: 30986 - DNA, 24 bp, Homo sapiens
aaagctgaattgaatcaatggttt

SEQ ID NO: 30987 - DNA, 25 bp, Homo sapiens
cattctttaaaggttattaaagttt

SEQ ID NO: 30988 - DNA, 23 bp, Homo sapiens
tgatggagcggcagcagcagcag

SEQ ID NO: 30989 - DNA, 23 bp, Homo sapiens
ccgccagccttgtactgatgtcg

SEQ ID NO: 30990 - DNA, 23 bp, Homo sapiens
agaccctgaccctccctcccaag

SEQ ID NO: 30991 - DNA, 25 bp, Homo sapiens
tcggcgtctaagggtttaagtgtca

SEQ ID NO: 30992 - DNA, 24 bp, Homo sapiens
ctatcacagcaatactccactatg

SEQ ID NO: 30993 - DNA, 24 bp, Homo sapiens
tctatcacagcaatactccactat

SEQ ID NO: 30994 - DNA, 24 bp, Homo sapiens
ttctatcacagcaatactccacta

SEQ ID NO: 30995 - DNA, 23 bp, Homo sapiens
ttcgtttgcgtcctaccaccagc

SEQ ID NO: 30996 - DNA, 23 bp, Homo sapiens
accagcaccagcacccacccaag

SEQ ID NO: 30997 - DNA, 23 bp, Homo sapiens
cctccttccagagcaagacgccg

SEQ ID NO: 30998 - DNA, 23 bp, Homo sapiens
ccgccgccgccgccgccgccgcc

SEQ ID NO: 30999 - DNA, 23 bp, Homo sapiens
gtgaccgttggcgccgaggggag

SEQ ID NO: 31000 - DNA, 23 bp, Homo sapiens
cggctttggacgagggcagaacc

SEQ ID NO: 31001 - DNA, 25 bp, Homo sapiens
gcccagacccaggattccaaacttg

SEQ ID NO: 31002 - DNA, 23 bp, Homo sapiens
cggcaaagtggcgactcaacctt

SEQ ID NO: 31003 - DNA, 24 bp, Homo sapiens
taaacatcaaggtaaattatttat

SEQ ID NO: 31004 - DNA, 24 bp, Homo sapiens
ttaaacatcaaggtaaattattta

SEQ ID NO: 31005 - DNA, 24 bp, Homo sapiens
cttaaacatcaaggtaaattattt

SEQ ID NO: 31006 - DNA, 24 bp, Homo sapiens
tctggttccgcctctactggttcc

SEQ ID NO: 31007 - DNA, 24 bp, Homo sapiens
aggtcctgtatgccaccagtcact

SEQ ID NO: 31008 - DNA, 24 bp, Homo sapiens
ctcctgctgctgctcacccttatg

SEQ ID NO: 31009 - DNA, 24 bp, Homo sapiens
cctgctgggtgcacaagcacttca

SEQ ID NO: 31010 - DNA, 24 bp, Homo sapiens
gcctgctgggtgcacaagcacttc

SEQ ID NO: 31011 - DNA, 24 bp, Homo sapiens
cgcctgctgggtgcacaagcactt

SEQ ID NO: 31012 - DNA, 24 bp, Homo sapiens
tttttctataggaatgtatcctgt

SEQ ID NO: 31013 - DNA, 24 bp, Homo sapiens
ctttttctataggaatgtatcctg

SEQ ID NO: 31014 - DNA, 24 bp, Homo sapiens
gctttttctataggaatgtatcct

SEQ ID NO: 31015 - DNA, 24 bp, Homo sapiens
cccttactacggaggagaaagtgc

SEQ ID NO: 31016 - DNA, 24 bp, Homo sapiens
aaataccaggatcaccacccgagt

SEQ ID NO: 31017 - DNA, 24 bp, Homo sapiens
ggagaggaagagactggaatgttg

SEQ ID NO: 31018 - DNA, 23 bp, Homo sapiens
agcagtctcaaccacctcagcct

SEQ ID NO: 31019 - DNA, 24 bp, Homo sapiens
aggctcctccaggctcttatgtcc

SEQ ID NO: 31020 - DNA, 24 bp, Homo sapiens
aacactccgtcaggcacaatggaa

SEQ ID NO: 31021 - DNA, 24 bp, Homo sapiens
aaacagaaaagcaaaactcatcag

SEQ ID NO: 31022 - DNA, 24 bp, Homo sapiens
caaacagaaaagcaaaactcatca

SEQ ID NO: 31023 - DNA, 24 bp, Homo sapiens
gcaaacagaaaagcaaaactcatc

SEQ ID NO: 31024 - DNA, 24 bp, Homo sapiens
tacatgtcttagtgagtttgtaaa

SEQ ID NO: 31025 - DNA, 24 bp, Homo sapiens
atacatgtcttagtgagtttgtaa

SEQ ID NO: 31026 - DNA, 24 bp, Homo sapiens
aatacatgtcttagtgagtttgta

SEQ ID NO: 31027 - DNA, 24 bp, Homo sapiens
agaaaaaaaagaaaagaaaggaac

SEQ ID NO: 31028 - DNA, 24 bp, Homo sapiens
cagaaaaaaaagaaaagaaaggaa

SEQ ID NO: 31029 - DNA, 24 bp, Homo sapiens
acagaaaaaaaagaaaagaaagga

SEQ ID NO: 31030 - DNA, 24 bp, Homo sapiens
tagacgagaccctccgctctttgg

SEQ ID NO: 31031 - DNA, 24 bp, Homo sapiens
gctgtgtgccgccgaatccaactg

SEQ ID NO: 31032 - DNA, 24 bp, Homo sapiens
ccttggaggtcttgcaggagagcc

SEQ ID NO: 31033 - DNA, 24 bp, Homo sapiens
actttttcaagggtggaataatta

SEQ ID NO: 31034 - DNA, 24 bp, Homo sapiens
gactttttcaagggtggaataatt

SEQ ID NO: 31035 - DNA, 24 bp, Homo sapiens
agactttttcaagggtggaataat

SEQ ID NO: 31036 - DNA, 24 bp, Homo sapiens
actaatagaaaattttattgtcaa

SEQ ID NO: 31037 - DNA, 24 bp, Homo sapiens
aactaatagaaaattttattgtca

SEQ ID NO: 31038 - DNA, 24 bp, Homo sapiens
aaactaatagaaaattttattgtc

SEQ ID NO: 31039 - DNA, 24 bp, Homo sapiens
tacaggcttcagcagagtgtgagg

SEQ ID NO: 31040 - DNA, 24 bp, Homo sapiens
gtggtcctggtgctggtcattgtc

SEQ ID NO: 31041 - DNA, 24 bp, Homo sapiens
gcctccaaggaacctgacaaccat

SEQ ID NO: 31042 - DNA, 24 bp, Homo sapiens
ctacaagcccgagttctacacgcc

SEQ ID NO: 31043 - DNA, 24 bp, Homo sapiens
cactgctcacctgtctgtcgtcgc

SEQ ID NO: 31044 - DNA, 24 bp, Homo sapiens
gccaccagcaccatcaacctctac

SEQ ID NO: 31045 - DNA, 24 bp, Homo sapiens
gagctggcgctgctggtgctgtac

SEQ ID NO: 31046 - DNA, 24 bp, Homo sapiens
cctgaggtcactgtgacgagggct

SEQ ID NO: 31047 - DNA, 24 bp, Homo sapiens
cctcgctgaggttccaggagcccc

SEQ ID NO: 31048 - DNA, 23 bp, Homo sapiens
cgggagacgttcctgccatcggg

SEQ ID NO: 31049 - DNA, 23 bp, Homo sapiens
cactacctggctcgttgctgcat

SEQ ID NO: 31050 - DNA, 25 bp, Homo sapiens
ctggctgaggtgctggatgtacttg

SEQ ID NO: 31051 - DNA, 23 bp, Homo sapiens
cactacctggctcgttgctgcat

SEQ ID NO: 31052 - DNA, 25 bp, Homo sapiens
ctggctgaggtgctggatgtacttg

SEQ ID NO: 31053 - DNA, 23 bp, Homo sapiens
tggcaacctcacactggagatgg

SEQ ID NO: 31054 - DNA, 25 bp, Homo sapiens
aggaccaacaacttcatcatcgctg

SEQ ID NO: 31055 - DNA, 23 bp, Homo sapiens
gagccaccatcctgtagagcagc

SEQ ID NO: 31056 - DNA, 23 bp, Homo sapiens
tggtggtggtggtggtgagtgtc

SEQ ID NO: 31057 - DNA, 24 bp, Homo sapiens
cagcgtcgtcaaccctcagagcat

SEQ ID NO: 31058 - DNA, 24 bp, Homo sapiens
caaggtctgctcggatattggacg

SEQ ID NO: 31059 - DNA, 24 bp, Homo sapiens
cattgtgctggctgtggtcctctc

SEQ ID NO: 31060 - DNA, 23 bp, Homo sapiens
gagtcagcaggagcccacccagg

SEQ ID NO: 31061 - DNA, 25 bp, Homo sapiens
tgacagtgacggatgctaatctggt

SEQ ID NO: 31062 - DNA, 23 bp, Homo sapiens
tcgcctgctgcctgcctccttcc

SEQ ID NO: 31063 - DNA, 24 bp, Homo sapiens
aagaagaatgactggaaacacaac

SEQ ID NO: 31064 - DNA, 24 bp, Homo sapiens
gaagaagaatgactggaaacacaa

SEQ ID NO: 31065 - DNA, 24 bp, Homo sapiens
ggaagaagaatgactggaaacaca

SEQ ID NO: 31066 - DNA, 24 bp, Homo sapiens
tactgaaccaggtatattattttt

SEQ ID NO: 31067 - DNA, 24 bp, Homo sapiens
ttactgaaccaggtatattatttt

SEQ ID NO: 31068 - DNA, 24 bp, Homo sapiens
cttactgaaccaggtatattattt

SEQ ID NO: 31069 - DNA, 24 bp, Homo sapiens
ggattcaaagagaacttagattat

SEQ ID NO: 31070 - DNA, 24 bp, Homo sapiens
tggattcaaagagaacttagatta

SEQ ID NO: 31071 - DNA, 24 bp, Homo sapiens
gtggattcaaagagaacttagatt

SEQ ID NO: 31072 - DNA, 24 bp, Homo sapiens
gtctcctgcagtgttatttacttg

SEQ ID NO: 31073 - DNA, 24 bp, Homo sapiens
agtctcctgcagtgttatttactt

SEQ ID NO: 31074 - DNA, 24 bp, Homo sapiens
aagtctcctgcagtgttatttact

SEQ ID NO: 31075 - DNA, 24 bp, Homo sapiens
caaaatataaaattcttgctttaa

SEQ ID NO: 31076 - DNA, 24 bp, Homo sapiens
gcaaaatataaaattcttgcttta

SEQ ID NO: 31077 - DNA, 24 bp, Homo sapiens
tgcaaaatataaaattcttgcttt

SEQ ID NO: 31078 - DNA, 24 bp, Homo sapiens
agcaaatgccaggtctagcaaaca

SEQ ID NO: 31079 - DNA, 24 bp, Homo sapiens
gagcaaatgccaggtctagcaaac

SEQ ID NO: 31080 - DNA, 24 bp, Homo sapiens
cgagcaaatgccaggtctagcaaa

SEQ ID NO: 31081 - DNA, 25 bp, Homo sapiens
accttatgtaccgagcaaatgccag

SEQ ID NO: 31082 - DNA, 25 bp, Homo sapiens
tgtggaatagctcagaatgtcagtt

SEQ ID NO: 31083 - DNA, 25 bp, Homo sapiens
aagaaacttgtgcttcaccgaagaa

SEQ ID NO: 31084 - DNA, 24 bp, Homo sapiens
taatattttaggaacaagttccag

SEQ ID NO: 31085 - DNA, 24 bp, Homo sapiens
ttaatattttaggaacaagttcca

SEQ ID NO: 31086 - DNA, 24 bp, Homo sapiens
tttaatattttaggaacaagttcc

SEQ ID NO: 31087 - DNA, 24 bp, Homo sapiens
gccctggtgatgtactccaacctc

SEQ ID NO: 31088 - DNA, 24 bp, Homo sapiens
ggccctggtgatgtactccaacct

SEQ ID NO: 31089 - DNA, 24 bp, Homo sapiens
aggccctggtgatgtactccaacc

SEQ ID NO: 31090 - DNA, 24 bp, Homo sapiens
atggctggcagtgtcctgttggat

SEQ ID NO: 31091 - DNA, 24 bp, Homo sapiens
catggctggcagtgtcctgttgga

SEQ ID NO: 31092 - DNA, 24 bp, Homo sapiens
ccatggctggcagtgtcctgttgg

SEQ ID NO: 31093 - DNA, 24 bp, Homo sapiens
acctcttttagaaattgatgatgc

SEQ ID NO: 31094 - DNA, 24 bp, Homo sapiens
aacctcttttagaaattgatgatg

SEQ ID NO: 31095 - DNA, 24 bp, Homo sapiens
aaacctcttttagaaattgatgat

SEQ ID NO: 31096 - DNA, 25 bp, Homo sapiens
cggctcactgtagtctcaacctcct

SEQ ID NO: 31097 - DNA, 25 bp, Homo sapiens
tcttgagacactccagatgaaggtt

SEQ ID NO: 31098 - DNA, 25 bp, Homo sapiens
acaataatggacctgtgtaaggagg

SEQ ID NO: 31099 - DNA, 25 bp, Homo sapiens
ctcactcaactcacagaggagcaga

SEQ ID NO: 31100 - DNA, 25 bp, Homo sapiens
tctcagttcaccttccagctacaca

SEQ ID NO: 31101 - DNA, 25 bp, Homo sapiens
caagtccaaggtcacacagccaagt

SEQ ID NO: 31102 - DNA, 24 bp, Homo sapiens
gcaggcaggcgacggaggcccggg

SEQ ID NO: 31103 - DNA, 24 bp, Homo sapiens
ggcaggcaggcgacggaggcccgg

SEQ ID NO: 31104 - DNA, 24 bp, Homo sapiens
cggcaggcaggcgacggaggcccg

SEQ ID NO: 31105 - DNA, 24 bp, Homo sapiens
gagagagaaagctttttgcctgaa

SEQ ID NO: 31106 - DNA, 24 bp, Homo sapiens
agagagagaaagctttttgcctga

SEQ ID NO: 31107 - DNA, 24 bp, Homo sapiens
gagagagagaaagctttttgcctg

SEQ ID NO: 31108 - DNA, 25 bp, Homo sapiens
tgctcaacaagaacgattcacctgg

SEQ ID NO: 31109 - DNA, 24 bp, Homo sapiens
catccataagtgtgcctctgcctt

SEQ ID NO: 31110 - DNA, 23 bp, Homo sapiens
ggtctggtgttgtgactgtggaa

SEQ ID NO: 31111 - DNA, 24 bp, Homo sapiens
tgagtgccatggattggcatctct

SEQ ID NO: 31112 - DNA, 24 bp, Homo sapiens
ctgagtgccatggattggcatctc

SEQ ID NO: 31113 - DNA, 24 bp, Homo sapiens
cctgagtgccatggattggcatct

SEQ ID NO: 31114 - DNA, 23 bp, Homo sapiens
ttcagcagcaacagcggcgtcat

SEQ ID NO: 31115 - DNA, 24 bp, Homo sapiens
gccatttacaacctcaagaagccc

SEQ ID NO: 31116 - DNA, 23 bp, Homo sapiens
ctgctctacagcctgaagaaccc

SEQ ID NO: 31117 - DNA, 24 bp, Homo sapiens
aatcctactccagccaattcctcg

SEQ ID NO: 31118 - DNA, 25 bp, Homo sapiens
ccacaccaaggtcttcatgtcctgc

SEQ ID NO: 31119 - DNA, 25 bp, Homo sapiens
atctatgacctgaactcagccgtgg

SEQ ID NO: 31120 - DNA, 25 bp, Homo sapiens
gcgaaactggacaaactgctgaacc

SEQ ID NO: 31121 - DNA, 25 bp, Homo sapiens
agtctctgtcccatcgcttgaatac

SEQ ID NO: 31122 - DNA, 23 bp, Homo sapiens
tacccagcccagccttagcaccc

SEQ ID NO: 31123 - DNA, 24 bp, Homo sapiens
ttcctccaaaggaaaaccaactct

SEQ ID NO: 31124 - DNA, 24 bp, Homo sapiens
tttcctccaaaggaaaaccaactc

SEQ ID NO: 31125 - DNA, 24 bp, Homo sapiens
ttttcctccaaaggaaaaccaact

SEQ ID NO: 31126 - DNA, 24 bp, Homo sapiens
ctttataaaaggggacactttgct

SEQ ID NO: 31127 - DNA, 24 bp, Homo sapiens
cctttataaaaggggacactttgc

SEQ ID NO: 31128 - DNA, 24 bp, Homo sapiens
acctttataaaaggggacactttg

SEQ ID NO: 31129 - DNA, 24 bp, Homo sapiens
agatgtcactggtaagtgtatatc

SEQ ID NO: 31130 - DNA, 24 bp, Homo sapiens
cagatgtcactggtaagtgtatat

SEQ ID NO: 31131 - DNA, 24 bp, Homo sapiens
acagatgtcactggtaagtgtata

SEQ ID NO: 31132 - DNA, 24 bp, Homo sapiens
tagtaccaaaggttgcagtatttt

SEQ ID NO: 31133 - DNA, 24 bp, Homo sapiens
atagtaccaaaggttgcagtattt

SEQ ID NO: 31134 - DNA, 24 bp, Homo sapiens
aatagtaccaaaggttgcagtatt

SEQ ID NO: 31135 - DNA, 24 bp, Homo sapiens
tattttaacaggttgcagtatttt

SEQ ID NO: 31136 - DNA, 24 bp, Homo sapiens
gtattttaacaggttgcagtattt

SEQ ID NO: 31137 - DNA, 24 bp, Homo sapiens
tgtattttaacaggttgcagtatt

SEQ ID NO: 31138 - DNA, 24 bp, Homo sapiens
ggggcacacaggcgcacttgcaac

SEQ ID NO: 31139 - DNA, 24 bp, Homo sapiens
aggggcacacaggcgcacttgcaa

SEQ ID NO: 31140 - DNA, 24 bp, Homo sapiens
caggggcacacaggcgcacttgca

SEQ ID NO: 31141 - DNA, 24 bp, Homo sapiens
ggagtacacaggcaaaatgaggcc

SEQ ID NO: 31142 - DNA, 24 bp, Homo sapiens
aggagtacacaggcaaaatgaggc

SEQ ID NO: 31143 - DNA, 24 bp, Homo sapiens
caggagtacacaggcaaaatgagg

SEQ ID NO: 31144 - DNA, 24 bp, Homo sapiens
ctttcttaaagatttgcacaattt

SEQ ID NO: 31145 - DNA, 24 bp, Homo sapiens
tctttcttaaagatttgcacaatt

SEQ ID NO: 31146 - DNA, 24 bp, Homo sapiens
ttctttcttaaagatttgcacaat

SEQ ID NO: 31147 - DNA, 23 bp, Homo sapiens
caccttgaggccttggacctgct

SEQ ID NO: 31148 - DNA, 23 bp, Homo sapiens
ccctgcggctgctgctgctgccc

SEQ ID NO: 31149 - DNA, 23 bp, Homo sapiens
gccgtgaactctactgcctgctg

SEQ ID NO: 31150 - DNA, 23 bp, Homo sapiens
ctcctcgctgcccacctcctctt

SEQ ID NO: 31151 - DNA, 24 bp, Homo sapiens
gccagcgagaagatagccttgagg

SEQ ID NO: 31152 - DNA, 24 bp, Homo sapiens
attggaggaatagctattaagaat

SEQ ID NO: 31153 - DNA, 24 bp, Homo sapiens
cattggaggaatagctattaagaa

SEQ ID NO: 31154 - DNA, 24 bp, Homo sapiens
ccattggaggaatagctattaaga

SEQ ID NO: 31155 - DNA, 24 bp, Homo sapiens
acttctggtgcgttcttcgtctcg

SEQ ID NO: 31156 - DNA, 23 bp, Homo sapiens
ctcgccacaacctccacctcctg

SEQ ID NO: 31157 - DNA, 25 bp, Homo sapiens
aactcctgaccttgtgatctgctgg

SEQ ID NO: 31158 - DNA, 24 bp, Homo sapiens
tttctttacagatattgatgatgt

SEQ ID NO: 31159 - DNA, 24 bp, Homo sapiens
ttttctttacagatattgatgatg

SEQ ID NO: 31160 - DNA, 24 bp, Homo sapiens
tttttctttacagatattgatgat

SEQ ID NO: 31161 - DNA, 24 bp, Homo sapiens
atgaatatgagattgccaccaagg

SEQ ID NO: 31162 - DNA, 24 bp, Homo sapiens
gatgaatatgagattgccaccaag

SEQ ID NO: 31163 - DNA, 24 bp, Homo sapiens
tgatgaatatgagattgccaccaa

SEQ ID NO: 31164 - DNA, 23 bp, Homo sapiens
catgttagaatggagcagtctgg

SEQ ID NO: 31165 - DNA, 25 bp, Homo sapiens
gaggcgagctaagaggatctcctga

SEQ ID NO: 31166 - DNA, 23 bp, Homo sapiens
ggctcatgcctgtaatcccagca

SEQ ID NO: 31167 - DNA, 23 bp, Homo sapiens
atgaatcccattaaacaatatgt

SEQ ID NO: 31168 - DNA, 24 bp, Homo sapiens
ccttacaagggttatatatggaat

SEQ ID NO: 31169 - DNA, 24 bp, Homo sapiens
tggaaagctacgctatgtggcgaa

SEQ ID NO: 31170 - DNA, 24 bp, Homo sapiens
cagaaaaaacggaaagagaatact

SEQ ID NO: 31171 - DNA, 24 bp, Homo sapiens
tcagaaaaaacggaaagagaatac

SEQ ID NO: 31172 - DNA, 24 bp, Homo sapiens
ttcagaaaaaacggaaagagaata

SEQ ID NO: 31173 - DNA, 24 bp, Homo sapiens
ttgattcagagaaagctgttgaca

SEQ ID NO: 31174 - DNA, 24 bp, Homo sapiens
tttgattcagagaaagctgttgac

SEQ ID NO: 31175 - DNA, 24 bp, Homo sapiens
ttttgattcagagaaagctgttga

SEQ ID NO: 31176 - DNA, 24 bp, Homo sapiens
tcttgttgatgaggagaacatctg

SEQ ID NO: 31177 - DNA, 24 bp, Homo sapiens
ttcttgttgatgaggagaacatct

SEQ ID NO: 31178 - DNA, 24 bp, Homo sapiens
gttcttgttgatgaggagaacatc

SEQ ID NO: 31179 - DNA, 23 bp, Homo sapiens
caaggtggtggctcagggtgaag

SEQ ID NO: 31180 - DNA, 24 bp, Homo sapiens
gtccgttctcagggctttgtcacc

SEQ ID NO: 31181 - DNA, 24 bp, Homo sapiens
ggaaactgggctatgacactgggc

SEQ ID NO: 31182 - DNA, 24 bp, Homo sapiens
gaatcagccgggtaagcgctggga

SEQ ID NO: 31183 - DNA, 24 bp, Homo sapiens
agaatcagccgggtaagcgctggg

SEQ ID NO: 31184 - DNA, 24 bp, Homo sapiens
gagaatcagccgggtaagcgctgg

SEQ ID NO: 31185 - DNA, 24 bp, Homo sapiens
gggaaagaaagtttggatttgaaa

SEQ ID NO: 31186 - DNA, 24 bp, Homo sapiens
tgggaaagaaagtttggatttgaa

SEQ ID NO: 31187 - DNA, 24 bp, Homo sapiens
atgggaaagaaagtttggatttga

SEQ ID NO: 31188 - DNA, 24 bp, Homo sapiens
aaaatttcaggggtaagacgtgac

SEQ ID NO: 31189 - DNA, 24 bp, Homo sapiens
taaaatttcaggggtaagacgtga

SEQ ID NO: 31190 - DNA, 24 bp, Homo sapiens
ttaaaatttcaggggtaagacgtg

SEQ ID NO: 31191 - DNA, 24 bp, Homo sapiens
tctcttgacctcgtgatccgcctg

SEQ ID NO: 31192 - DNA, 25 bp, Homo sapiens
ttcggtctctccacattgaagtaga

SEQ ID NO: 31193 - DNA, 23 bp, Homo sapiens
ttatcacattaccttgtctcatc

SEQ ID NO: 31194 - DNA, 24 bp, Homo sapiens
cctctcctgaacttaccgccactc

SEQ ID NO: 31195 - DNA, 23 bp, Homo sapiens
gccttggagatgccgaagagacg

SEQ ID NO: 31196 - DNA, 24 bp, Homo sapiens
ggactctgctcatcactgtctggc

SEQ ID NO: 31197 - DNA, 23 bp, Homo sapiens
agaggtggcgtgggctggctttg

SEQ ID NO: 31198 - DNA, 25 bp, Homo sapiens
tcctcaagacgacgaacaatgaact

SEQ ID NO: 31199 - DNA, 23 bp, Homo sapiens
ctgtgtgagccgcctgccctttc

SEQ ID NO: 31200 - DNA, 24 bp, Homo sapiens
taaatcccaaggtattgtaaagtt

SEQ ID NO: 31201 - DNA, 24 bp, Homo sapiens
ataaatcccaaggtattgtaaagt

SEQ ID NO: 31202 - DNA, 24 bp, Homo sapiens
gataaatcccaaggtattgtaaag

SEQ ID NO: 31203 - DNA, 24 bp, Homo sapiens
tataccagtaggttagtaagtctt

SEQ ID NO: 31204 - DNA, 24 bp, Homo sapiens
atataccagtaggttagtaagtct

SEQ ID NO: 31205 - DNA, 24 bp, Homo sapiens
tatataccagtaggttagtaagtc

SEQ ID NO: 31206 - DNA, 24 bp, Homo sapiens
actttgtcaaggtaagaatttctt

SEQ ID NO: 31207 - DNA, 24 bp, Homo sapiens
aactttgtcaaggtaagaatttct

SEQ ID NO: 31208 - DNA, 24 bp, Homo sapiens
taactttgtcaaggtaagaatttc

SEQ ID NO: 31209 - DNA, 23 bp, Homo sapiens
ctcaaagaaggcagttttggggc

SEQ ID NO: 31210 - DNA, 23 bp, Homo sapiens
ggccgacctgaagctggtttcat

SEQ ID NO: 31211 - DNA, 23 bp, Homo sapiens
cccgccgccgtcacccaggaaac

SEQ ID NO: 31212 - DNA, 24 bp, Homo sapiens
cgtcatttaagaaacctcaaatat

SEQ ID NO: 31213 - DNA, 24 bp, Homo sapiens
gcgtcatttaagaaacctcaaata

SEQ ID NO: 31214 - DNA, 24 bp, Homo sapiens
tgcgtcatttaagaaacctcaaat

SEQ ID NO: 31215 - DNA, 24 bp, Homo sapiens
tatacaaattggtgagttgaattc

SEQ ID NO: 31216 - DNA, 24 bp, Homo sapiens
gtatacaaattggtgagttgaatt

SEQ ID NO: 31217 - DNA, 24 bp, Homo sapiens
agtatacaaattggtgagttgaat

SEQ ID NO: 31218 - DNA, 23 bp, Homo sapiens
ctggtcctgctgctgctcctctc

SEQ ID NO: 31219 - DNA, 24 bp, Homo sapiens
gctcctatccatgatgctgacgcc

SEQ ID NO: 31220 - DNA, 23 bp, Homo sapiens
agaggagaaccaggagcaccagc

SEQ ID NO: 31221 - DNA, 25 bp, Homo sapiens
agcatcatcagaagtgaacctggca

SEQ ID NO: 31222 - DNA, 25 bp, Homo sapiens
cacaatgagaccaacacagacacga

SEQ ID NO: 31223 - DNA, 25 bp, Homo sapiens
tcacaagataaccaacaaccagact

SEQ ID NO: 31224 - DNA, 24 bp, Homo sapiens
aaagacagaaaacagtagctcttg

SEQ ID NO: 31225 - DNA, 24 bp, Homo sapiens
gaaagacagaaaacagtagctctt

SEQ ID NO: 31226 - DNA, 24 bp, Homo sapiens
tgaaagacagaaaacagtagctct

SEQ ID NO: 31227 - DNA, 24 bp, Homo sapiens
ctttttaccaggtaatatagactt

SEQ ID NO: 31228 - DNA, 24 bp, Homo sapiens
gctttttaccaggtaatatagact

SEQ ID NO: 31229 - DNA, 24 bp, Homo sapiens
tgctttttaccaggtaatatagac

SEQ ID NO: 31230 - DNA, 24 bp, Homo sapiens
gtcatcaaaaagtacctattgaag

SEQ ID NO: 31231 - DNA, 24 bp, Homo sapiens
agtcatcaaaaagtacctattgaa

SEQ ID NO: 31232 - DNA, 24 bp, Homo sapiens
cagtcatcaaaaagtacctattga

SEQ ID NO: 31233 - DNA, 25 bp, Homo sapiens
tgccattcagatactcaagacctgc

SEQ ID NO: 31234 - DNA, 23 bp, Homo sapiens
gatccacctgcccgccaccaaag

SEQ ID NO: 31235 - DNA, 24 bp, Homo sapiens
gccaggactcggatgaagacgatg

SEQ ID NO: 31236 - DNA, 24 bp, Homo sapiens
gacaatgcaagagatgcaggggct

SEQ ID NO: 31237 - DNA, 24 bp, Homo sapiens
ggacaatgcaagagatgcaggggc

SEQ ID NO: 31238 - DNA, 24 bp, Homo sapiens
tggacaatgcaagagatgcagggg

SEQ ID NO: 31239 - DNA, 24 bp, Homo sapiens
tttaaaccaagaaaaacaggagct

SEQ ID NO: 31240 - DNA, 24 bp, Homo sapiens
ttttaaaccaagaaaaacaggagc

SEQ ID NO: 31241 - DNA, 24 bp, Homo sapiens
cttttaaaccaagaaaaacaggag

SEQ ID NO: 31242 - DNA, 24 bp, Homo sapiens
gcccagcccagggaagcggcagcc

SEQ ID NO: 31243 - DNA, 24 bp, Homo sapiens
agcccagcccagggaagcggcagc

SEQ ID NO: 31244 - DNA, 24 bp, Homo sapiens
gagcccagcccagggaagcggcag

SEQ ID NO: 31245 - DNA, 23 bp, Homo sapiens
aagaggaggctgcggaaggttgt

SEQ ID NO: 31246 - DNA, 23 bp, Homo sapiens
gttccagacctgccttaccatgc

SEQ ID NO: 31247 - DNA, 24 bp, Homo sapiens
cccgagaggaggactttgaccagc

SEQ ID NO: 31248 - DNA, 24 bp, Homo sapiens
cctacgggaggacgatctggtctc

SEQ ID NO: 31249 - DNA, 25 bp, Homo sapiens
tcagcactgtcagagagatggatgt

SEQ ID NO: 31250 - DNA, 23 bp, Homo sapiens
aagaggaggctgcggaaggttgt

SEQ ID NO: 31251 - DNA, 24 bp, Homo sapiens
tatcttcaaaggaccaaagtgctt

SEQ ID NO: 31252 - DNA, 24 bp, Homo sapiens
ttatcttcaaaggaccaaagtgct

SEQ ID NO: 31253 - DNA, 24 bp, Homo sapiens
cttatcttcaaaggaccaaagtgc

SEQ ID NO: 31254 - DNA, 24 bp, Homo sapiens
agctcacgcctgtaatcccatcac

SEQ ID NO: 31255 - DNA, 24 bp, Homo sapiens
cagctcacgcctgtaatcccatca

SEQ ID NO: 31256 - DNA, 24 bp, Homo sapiens
gcagctcacgcctgtaatcccatc

SEQ ID NO: 31257 - DNA, 24 bp, Homo sapiens
gccctggaagccgaactgaaagat

SEQ ID NO: 31258 - DNA, 24 bp, Homo sapiens
ttcctggaggagactcagcaagcc

SEQ ID NO: 31259 - DNA, 24 bp, Homo sapiens
gaggtggagcagcatcagcaggag

SEQ ID NO: 31260 - DNA, 24 bp, Homo sapiens
acagcctccagatccaacaccaga

SEQ ID NO: 31261 - DNA, 24 bp, Homo sapiens
gctgctagagtcgctcagacagga

SEQ ID NO: 31262 - DNA, 24 bp, Homo sapiens
cagacagcaagccagcagccagtg

SEQ ID NO: 31263 - DNA, 24 bp, Homo sapiens
gaggtggagcagcatcagcaggag

SEQ ID NO: 31264 - DNA, 24 bp, Homo sapiens
atcacataatcgccacagaggagc

SEQ ID NO: 31265 - DNA, 24 bp, Homo sapiens
cagacagcaagccagcagccagtg

SEQ ID NO: 31266 - DNA, 25 bp, Homo sapiens
cgtgttggagatgattggagaaggc

SEQ ID NO: 31267 - DNA, 25 bp, Homo sapiens
cagatgttgtggaactgtccctgga

SEQ ID NO: 31268 - DNA, 24 bp, Homo sapiens
ttgtcctctgaacttctcaccagt

SEQ ID NO: 31269 - DNA, 23 bp, Homo sapiens
gtcagcacgcacagcccactcgc

SEQ ID NO: 31270 - DNA, 23 bp, Homo sapiens
gacccgcgtgcaacgaagtggag

SEQ ID NO: 31271 - DNA, 23 bp, Homo sapiens
aagtccttcgcacaggctcgcag

SEQ ID NO: 31272 - DNA, 23 bp, Homo sapiens
gatcatccagcagcagcaggccg

SEQ ID NO: 31273 - DNA, 23 bp, Homo sapiens
ccttcctggccgtgggcagggtc

SEQ ID NO: 31274 - DNA, 24 bp, Homo sapiens
ttaaattcaagggttatttgatat

SEQ ID NO: 31275 - DNA, 24 bp, Homo sapiens
gttaaattcaagggttatttgata

SEQ ID NO: 31276 - DNA, 24 bp, Homo sapiens
ggttaaattcaagggttatttgat

SEQ ID NO: 31277 - DNA, 24 bp, Homo sapiens
ttgttggcttgaaacattatatgc

SEQ ID NO: 31278 - DNA, 24 bp, Homo sapiens
gttgttggcttgaaacattatatg

SEQ ID NO: 31279 - DNA, 24 bp, Homo sapiens
agttgttggcttgaaacattatat

SEQ ID NO: 31280 - DNA, 24 bp, Homo sapiens
caatggctcaggcagaagcctcct

SEQ ID NO: 31281 - DNA, 24 bp, Homo sapiens
acaatggctcaggcagaagcctcc

SEQ ID NO: 31282 - DNA, 24 bp, Homo sapiens
tacaatggctcaggcagaagcctc

SEQ ID NO: 31283 - DNA, 23 bp, Homo sapiens
gcggcactacgacttggacttgg

SEQ ID NO: 31284 - DNA, 23 bp, Homo sapiens
cttcaacgtgagcctggactcgg

SEQ ID NO: 31285 - DNA, 23 bp, Homo sapiens
cttccgtccctgctgctgctgct

SEQ ID NO: 31286 - DNA, 24 bp, Homo sapiens
actctcctcaggtcgcctgctccg

SEQ ID NO: 31287 - DNA, 24 bp, Homo sapiens
cactctcctcaggtcgcctgctcc

SEQ ID NO: 31288 - DNA, 24 bp, Homo sapiens
tcactctcctcaggtcgcctgctc

SEQ ID NO: 31289 - DNA, 23 bp, Homo sapiens
cttcagagcctccagtgcctgtg

SEQ ID NO: 31290 - DNA, 23 bp, Homo sapiens
cctggtgctgctgctggtgctca

SEQ ID NO: 31291 - DNA, 23 bp, Homo sapiens
ctggacctgctgcctgactacct

SEQ ID NO: 31292 - DNA, 23 bp, Homo sapiens
cttcagagcctccagtgcctgtg

SEQ ID NO: 31293 - DNA, 23 bp, Homo sapiens
cctggtgctgctgctggtgctca

SEQ ID NO: 31294 - DNA, 24 bp, Homo sapiens
gtctgagagtcactggagctacca

SEQ ID NO: 31295 - DNA, 25 bp, Homo sapiens
ccgatctctgattgctcctaactga

SEQ ID NO: 31296 - DNA, 23 bp, Homo sapiens
ggcgggacttatttgtcaggcgg

SEQ ID NO: 31297 - DNA, 23 bp, Homo sapiens
gctcaggtgattctcccgcctca

SEQ ID NO: 31298 - DNA, 25 bp, Homo sapiens
ttgacatcatagaccgagaagcaga

SEQ ID NO: 31299 - DNA, 25 bp, Homo sapiens
ccagagaacatctacctgtcggaac

SEQ ID NO: 31300 - DNA, 23 bp, Homo sapiens
gccgtgctgctggacttggaacc

SEQ ID NO: 31301 - DNA, 23 bp, Homo sapiens
ctgacactcaagaggctgacgca

SEQ ID NO: 31302 - DNA, 23 bp, Homo sapiens
agattgtgtggtggtgctggaca

SEQ ID NO: 31303 - DNA, 24 bp, Homo sapiens
acccgtccttctcccagatcaacc

SEQ ID NO: 31304 - DNA, 23 bp, Homo sapiens
ctgacactcaagaggctgacgca

SEQ ID NO: 31305 - DNA, 23 bp, Homo sapiens
agattgtgtggtggtgctggaca

SEQ ID NO: 31306 - DNA, 24 bp, Homo sapiens
cccgtccttctcccagatcaacca

SEQ ID NO: 31307 - DNA, 23 bp, Homo sapiens
gtgctgcgggactgcctgctgag

SEQ ID NO: 31308 - DNA, 23 bp, Homo sapiens
actggctggctgtggtggtgatg

SEQ ID NO: 31309 - DNA, 23 bp, Homo sapiens
ccttcagtctcttggctacacgg

SEQ ID NO: 31310 - DNA, 24 bp, Homo sapiens
agtgtgaacttgtacatgtttata

SEQ ID NO: 31311 - DNA, 24 bp, Homo sapiens
gagtgtgaacttgtacatgtttat

SEQ ID NO: 31312 - DNA, 24 bp, Homo sapiens
cgagtgtgaacttgtacatgttta

SEQ ID NO: 31313 - DNA, 24 bp, Homo sapiens
atgataaaaagtatagctctggga

SEQ ID NO: 31314 - DNA, 24 bp, Homo sapiens
tatgataaaaagtatagctctggg

SEQ ID NO: 31315 - DNA, 24 bp, Homo sapiens
ctatgataaaaagtatagctctgg

SEQ ID NO: 31316 - DNA, 23 bp, Homo sapiens
gtgctggctgtgctgtggtgctc

SEQ ID NO: 31317 - DNA, 23 bp, Homo sapiens
tccttcatctggtcctgcgagcg

SEQ ID NO: 31318 - DNA, 23 bp, Homo sapiens
tgcgcacagtgtgggagcaatgc

SEQ ID NO: 31319 - DNA, 23 bp, Homo sapiens
attgggaaagggcaggcacacag

SEQ ID NO: 31320 - DNA, 25 bp, Homo sapiens
ttcttctgggttctgggtttcatcc

SEQ ID NO: 31321 - DNA, 24 bp, Homo sapiens
agcagtacggtctttcagccctca

SEQ ID NO: 31322 - DNA, 23 bp, Homo sapiens
ctcccagcgtccacatcgtcctc

SEQ ID NO: 31323 - DNA, 23 bp, Homo sapiens
atctcctccacgcagaagccgaa

SEQ ID NO: 31324 - DNA, 23 bp, Homo sapiens
ctcctgcccctctgcctcccacc

SEQ ID NO: 31325 - DNA, 24 bp, Homo sapiens
ttcttttataggaatatatatgtc

SEQ ID NO: 31326 - DNA, 24 bp, Homo sapiens
tttcttttataggaatatatatgt

SEQ ID NO: 31327 - DNA, 24 bp, Homo sapiens
ctttcttttataggaatatatatg

SEQ ID NO: 31328 - DNA, 24 bp, Homo sapiens
aatgtttataggaaaatgaagaat

SEQ ID NO: 31329 - DNA, 24 bp, Homo sapiens
aaatgtttataggaaaatgaagaa

SEQ ID NO: 31330 - DNA, 24 bp, Homo sapiens
taaatgtttataggaaaatgaaga

SEQ ID NO: 31331 - DNA, 24 bp, Homo sapiens
aaactggtcagaaaataaatattc

SEQ ID NO: 31332 - DNA, 24 bp, Homo sapiens
gaaactggtcagaaaataaatatt

SEQ ID NO: 31333 - DNA, 24 bp, Homo sapiens
agaaactggtcagaaaataaatat

SEQ ID NO: 31334 - DNA, 24 bp, Homo sapiens
tccagatatatgtaagtgaaagtt

SEQ ID NO: 31335 - DNA, 24 bp, Homo sapiens
ctccagatatatgtaagtgaaagt

SEQ ID NO: 31336 - DNA, 24 bp, Homo sapiens
cctccagatatatgtaagtgaaag

SEQ ID NO: 31337 - DNA, 24 bp, Homo sapiens
aaatgaaaagagtaagtataacat

SEQ ID NO: 31338 - DNA, 24 bp, Homo sapiens
caaatgaaaagagtaagtataaca

SEQ ID NO: 31339 - DNA, 24 bp, Homo sapiens
ccaaatgaaaagagtaagtataac

SEQ ID NO: 31340 - DNA, 23 bp, Homo sapiens
gaggcggcggcagagacagaaga

SEQ ID NO: 31341 - DNA, 23 bp, Homo sapiens
cccgtgttactgggtagaagaaa

SEQ ID NO: 31342 - DNA, 23 bp, Homo sapiens
gaccacccggcctcggccaataa

SEQ ID NO: 31343 - DNA, 23 bp, Homo sapiens
ctacccagccctctgcccaccaa

SEQ ID NO: 31344 - DNA, 23 bp, Homo sapiens
ccacagggagggcagcagggtct

SEQ ID NO: 31345 - DNA, 23 bp, Homo sapiens
ctgcccgcaaggacgaccaaacc

SEQ ID NO: 31346 - DNA, 24 bp, Homo sapiens
gagagttttagaatatttctcttg

SEQ ID NO: 31347 - DNA, 24 bp, Homo sapiens
tgagagttttagaatatttctctt

SEQ ID NO: 31348 - DNA, 24 bp, Homo sapiens
ttgagagttttagaatatttctct

SEQ ID NO: 31349 - DNA, 24 bp, Homo sapiens
atggaggtggaggaagtcggtctg

SEQ ID NO: 31350 - DNA, 25 bp, Homo sapiens
gtgtcatctgtggaatcatcaaggt

SEQ ID NO: 31351 - DNA, 25 bp, Homo sapiens
agcatcatcccactgtctccctttg

SEQ ID NO: 31352 - DNA, 24 bp, Homo sapiens
accattttgagaatattcagtcca

SEQ ID NO: 31353 - DNA, 24 bp, Homo sapiens
gaccattttgagaatattcagtcc

SEQ ID NO: 31354 - DNA, 24 bp, Homo sapiens
tgaccattttgagaatattcagtc

SEQ ID NO: 31355 - DNA, 25 bp, Homo sapiens
gtatcagctcctccttgtacctctg

SEQ ID NO: 31356 - DNA, 23 bp, Homo sapiens
aaatgagttatggaggattccct

SEQ ID NO: 31357 - DNA, 23 bp, Homo sapiens
ttcagctgtgaatccgtctggtc

SEQ ID NO: 31358 - DNA, 24 bp, Homo sapiens
ggccgaagcagtggatgcagcact

SEQ ID NO: 31359 - DNA, 24 bp, Homo sapiens
gggccgaagcagtggatgcagcac

SEQ ID NO: 31360 - DNA, 24 bp, Homo sapiens
cgggccgaagcagtggatgcagca

SEQ ID NO: 31361 - DNA, 24 bp, Homo sapiens
tcacctatgaaacgttaaaataca

SEQ ID NO: 31362 - DNA, 24 bp, Homo sapiens
atcacctatgaaacgttaaaatac

SEQ ID NO: 31363 - DNA, 24 bp, Homo sapiens
tatcacctatgaaacgttaaaata

SEQ ID NO: 31364 - DNA, 23 bp, Homo sapiens
gcctgtgactgctgtggagatcc

SEQ ID NO: 31365 - DNA, 23 bp, Homo sapiens
ggtggaagagagtgaagagcggc

SEQ ID NO: 31366 - DNA, 23 bp, Homo sapiens
tcttctccacaccgtcaccagca

SEQ ID NO: 31367 - DNA, 25 bp, Homo sapiens
tgaaagagcagcgtaaagaaagtgg

SEQ ID NO: 31368 - DNA, 25 bp, Homo sapiens
acacagctctgggcaacagaacttg

SEQ ID NO: 31369 - DNA, 24 bp, Homo sapiens
atatgactgctgctgctcctatgc

SEQ ID NO: 31370 - DNA, 25 bp, Homo sapiens
cctacattcctcagtacacgcctgt

SEQ ID NO: 31371 - DNA, 24 bp, Homo sapiens
cagacagtggcaccttcatcccag

SEQ ID NO: 31372 - DNA, 24 bp, Homo sapiens
atatgactgctgctgctcctatgc

SEQ ID NO: 31373 - DNA, 25 bp, Homo sapiens
ccactgacacagcagatgaatcacc

SEQ ID NO: 31374 - DNA, 24 bp, Homo sapiens
atcacgccattcattgctgcttcc

SEQ ID NO: 31375 - DNA, 24 bp, Homo sapiens
ttcattttaagctctcccatttgg

SEQ ID NO: 31376 - DNA, 24 bp, Homo sapiens
tttcattttaagctctcccatttg

SEQ ID NO: 31377 - DNA, 24 bp, Homo sapiens
atttcattttaagctctcccattt

SEQ ID NO: 31378 - DNA, 24 bp, Homo sapiens
tcttgatctcctgacctcgtgacc

SEQ ID NO: 31379 - DNA, 24 bp, Homo sapiens
aaatgggactcacatacaactgtt

SEQ ID NO: 31380 - DNA, 24 bp, Homo sapiens
tgtgtgtattccttgcaaacgtag

SEQ ID NO: 31381 - DNA, 24 bp, Homo sapiens
ttgccttgcagctgtgtaaatgag

SEQ ID NO: 31382 - DNA, 24 bp, Homo sapiens
tttgccttgcagctgtgtaaatga

SEQ ID NO: 31383 - DNA, 24 bp, Homo sapiens
gtttgccttgcagctgtgtaaatg

SEQ ID NO: 31384 - DNA, 24 bp, Homo sapiens
aaaaagtaaagctacagatctggg

SEQ ID NO: 31385 - DNA, 24 bp, Homo sapiens
gaaaaagtaaagctacagatctgg

SEQ ID NO: 31386 - DNA, 24 bp, Homo sapiens
tgaaaaagtaaagctacagatctg

SEQ ID NO: 31387 - DNA, 24 bp, Homo sapiens
aaaaagtaaaggcaacaagattga

SEQ ID NO: 31388 - DNA, 24 bp, Homo sapiens
gaaaaagtaaaggcaacaagattg

SEQ ID NO: 31389 - DNA, 24 bp, Homo sapiens
tgaaaaagtaaaggcaacaagatt

SEQ ID NO: 31390 - DNA, 25 bp, Homo sapiens
agaggaagaggatgtggagattgga

SEQ ID NO: 31391 - DNA, 24 bp, Homo sapiens
gcaagatggctggtgtggtgatga

SEQ ID NO: 31392 - DNA, 25 bp, Homo sapiens
tctgttggtccacaagcattaagca

SEQ ID NO: 31393 - DNA, 23 bp, Homo sapiens
cggacgctttacgaacccagtgc

SEQ ID NO: 31394 - DNA, 23 bp, Homo sapiens
gctgcggactccagctcgctgtt

SEQ ID NO: 31395 - DNA, 25 bp, Homo sapiens
atccttttctgataacttaatcgac

SEQ ID NO: 31396 - DNA, 25 bp, Homo sapiens
tcagcaaggagtcagtagatcaaga

SEQ ID NO: 31397 - DNA, 25 bp, Homo sapiens
tggtacagtagagtatatggctcct

SEQ ID NO: 31398 - DNA, 25 bp, Homo sapiens
ccagagtgctgattggtggtcatat

SEQ ID NO: 31399 - DNA, 25 bp, Homo sapiens
tggtacagtagagtatatggctcct

SEQ ID NO: 31400 - DNA, 25 bp, Homo sapiens
ccagagtgctgattggtggtcatat

SEQ ID NO: 31401 - DNA, 25 bp, Homo sapiens
actctgccatttcaaggtaaagaca

SEQ ID NO: 31402 - DNA, 25 bp, Homo sapiens
ccattcccagagtgctgattggtgg

SEQ ID NO: 31403 - DNA, 25 bp, Homo sapiens
tggtacagtagagtatatggctcct

SEQ ID NO: 31404 - DNA, 25 bp, Homo sapiens
tcagcaaggagtcagtagatcaaga

SEQ ID NO: 31405 - DNA, 24 bp, Homo sapiens
aatctaaagaggtaaaaaatagat

SEQ ID NO: 31406 - DNA, 24 bp, Homo sapiens
aaatctaaagaggtaaaaaataga

SEQ ID NO: 31407 - DNA, 24 bp, Homo sapiens
caaatctaaagaggtaaaaaatag

SEQ ID NO: 31408 - DNA, 24 bp, Homo sapiens
ttatcctctagaattagactttct

SEQ ID NO: 31409 - DNA, 24 bp, Homo sapiens
cttatcctctagaattagactttc

SEQ ID NO: 31410 - DNA, 24 bp, Homo sapiens
tcttatcctctagaattagacttt

SEQ ID NO: 31411 - DNA, 24 bp, Homo sapiens
atagaaaagagaacaaagaggtga

SEQ ID NO: 31412 - DNA, 24 bp, Homo sapiens
tatagaaaagagaacaaagaggtg

SEQ ID NO: 31413 - DNA, 24 bp, Homo sapiens
atatagaaaagagaacaaagaggt

SEQ ID NO: 31414 - DNA, 24 bp, Homo sapiens
atgatgaaaatgtatgaccgggat

SEQ ID NO: 31415 - DNA, 24 bp, Homo sapiens
aatgatgaaaatgtatgaccggga

SEQ ID NO: 31416 - DNA, 24 bp, Homo sapiens
aaatgatgaaaatgtatgaccggg

SEQ ID NO: 31417 - DNA, 24 bp, Homo sapiens
tcaaactagaggaaccataaatcc

SEQ ID NO: 31418 - DNA, 24 bp, Homo sapiens
ttcaaactagaggaaccataaatc

SEQ ID NO: 31419 - DNA, 24 bp, Homo sapiens
cttcaaactagaggaaccataaat

SEQ ID NO: 31420 - DNA, 24 bp, Homo sapiens
taagctccagggagcatggagtct

SEQ ID NO: 31421 - DNA, 24 bp, Homo sapiens
ctaagctccagggagcatggagtc

SEQ ID NO: 31422 - DNA, 24 bp, Homo sapiens
gctaagctccagggagcatggagt

SEQ ID NO: 31423 - DNA, 24 bp, Homo sapiens
tcattttctagtattttgctgaaa

SEQ ID NO: 31424 - DNA, 24 bp, Homo sapiens
ctcattttctagtattttgctgaa

SEQ ID NO: 31425 - DNA, 24 bp, Homo sapiens
tctcattttctagtattttgctga

SEQ ID NO: 31426 - DNA, 24 bp, Homo sapiens
gagaaagaaaaaaatccagtagcc

SEQ ID NO: 31427 - DNA, 24 bp, Homo sapiens
agagaaagaaaaaaatccagtagc

SEQ ID NO: 31428 - DNA, 24 bp, Homo sapiens
cagagaaagaaaaaaatccagtag

SEQ ID NO: 31429 - DNA, 24 bp, Homo sapiens
tgatgagaaaggtctctgataaaa

SEQ ID NO: 31430 - DNA, 24 bp, Homo sapiens
ttgatgagaaaggtctctgataaa

SEQ ID NO: 31431 - DNA, 24 bp, Homo sapiens
tttgatgagaaaggtctctgataa

SEQ ID NO: 31432 - DNA, 24 bp, Homo sapiens
ttatattttaggtctctgataaaa

SEQ ID NO: 31433 - DNA, 24 bp, Homo sapiens
tttatattttaggtctctgataaa

SEQ ID NO: 31434 - DNA, 24 bp, Homo sapiens
ctttatattttaggtctctgataa

SEQ ID NO: 31435 - DNA, 25 bp, Homo sapiens
agtggatcagtgactacgcagactc

SEQ ID NO: 31436 - DNA, 25 bp, Homo sapiens
atgtggtgttccagaagccaagtgg

SEQ ID NO: 31437 - DNA, 24 bp, Homo sapiens
gagagcccaaaggagtcaaggtcg

SEQ ID NO: 31438 - DNA, 24 bp, Homo sapiens
cagattcacagattttggggtaag

SEQ ID NO: 31439 - DNA, 24 bp, Homo sapiens
tcagattcacagattttggggtaa

SEQ ID NO: 31440 - DNA, 24 bp, Homo sapiens
gtcagattcacagattttggggta

SEQ ID NO: 31441 - DNA, 24 bp, Homo sapiens
atttgctgaaggtttgtatgcagt

SEQ ID NO: 31442 - DNA, 24 bp, Homo sapiens
aatttgctgaaggtttgtatgcag

SEQ ID NO: 31443 - DNA, 24 bp, Homo sapiens
gaatttgctgaaggtttgtatgca

SEQ ID NO: 31444 - DNA, 24 bp, Homo sapiens
gacaccaagaggctctacggtttc

SEQ ID NO: 31445 - DNA, 24 bp, Homo sapiens
ggacaccaagaggctctacggttt

SEQ ID NO: 31446 - DNA, 24 bp, Homo sapiens
aggacaccaagaggctctacggtt

SEQ ID NO: 31447 - DNA, 24 bp, Homo sapiens
cggcctgcgaggctggtttccagc

SEQ ID NO: 31448 - DNA, 24 bp, Homo sapiens
acggcctgcgaggctggtttccag

SEQ ID NO: 31449 - DNA, 24 bp, Homo sapiens
aacggcctgcgaggctggtttcca

SEQ ID NO: 31450 - DNA, 25 bp, Homo sapiens
ccaaccagaacaagcagagcagtga

SEQ ID NO: 31451 - DNA, 23 bp, Homo sapiens
ctcagcagcagcagcaactgtct

SEQ ID NO: 31452 - DNA, 23 bp, Homo sapiens
cctcacctccatcaatgccacgc

SEQ ID NO: 31453 - DNA, 24 bp, Homo sapiens
agatgtgagcgagaaagccgttgc

SEQ ID NO: 31454 - DNA, 24 bp, Homo sapiens
agaattccatagtgaagtgctcca

SEQ ID NO: 31455 - DNA, 24 bp, Homo sapiens
gctccacgaccactgaaaagaaaa

SEQ ID NO: 31456 - DNA, 24 bp, Homo sapiens
ttataggctgggaaactaggttcc

SEQ ID NO: 31457 - DNA, 24 bp, Homo sapiens
tttataggctgggaaactaggttc

SEQ ID NO: 31458 - DNA, 24 bp, Homo sapiens
atttataggctgggaaactaggtt

SEQ ID NO: 31459 - DNA, 24 bp, Homo sapiens
aaacaacaatggtaagattgcaat

SEQ ID NO: 31460 - DNA, 24 bp, Homo sapiens
gaaacaacaatggtaagattgcaa

SEQ ID NO: 31461 - DNA, 24 bp, Homo sapiens
agaaacaacaatggtaagattgca

SEQ ID NO: 31462 - DNA, 23 bp, Homo sapiens
caccacctccgccaccacctcag

SEQ ID NO: 31463 - DNA, 24 bp, Homo sapiens
atggctatgtcaacaccctggctg

SEQ ID NO: 31464 - DNA, 25 bp, Homo sapiens
ccttgtcttctaccttctgtcacct

SEQ ID NO: 31465 - DNA, 24 bp, Homo sapiens
gaaccacacccaagtagctgccct

SEQ ID NO: 31466 - DNA, 24 bp, Homo sapiens
cagcagcagcagcagcagcagcag

SEQ ID NO: 31467 - DNA, 24 bp, Homo sapiens
cacccgcatccgctgcgggagtcc

SEQ ID NO: 31468 - DNA, 24 bp, Homo sapiens
aagcctcaaaggacattctgattg

SEQ ID NO: 31469 - DNA, 24 bp, Homo sapiens
taagcctcaaaggacattctgatt

SEQ ID NO: 31470 - DNA, 24 bp, Homo sapiens
gtaagcctcaaaggacattctgat

SEQ ID NO: 31471 - DNA, 24 bp, Homo sapiens
agtctggcttggaatataaatagt

SEQ ID NO: 31472 - DNA, 24 bp, Homo sapiens
aagtctggcttggaatataaatag

SEQ ID NO: 31473 - DNA, 24 bp, Homo sapiens
caagtctggcttggaatataaata

SEQ ID NO: 31474 - DNA, 25 bp, Homo sapiens
ggttctgctgggctcagtattcctc

SEQ ID NO: 31475 - DNA, 25 bp, Homo sapiens
tggcgatgggttgatattgctcttg

SEQ ID NO: 31476 - DNA, 25 bp, Homo sapiens
tgccattcacaaccctttcagacct

SEQ ID NO: 31477 - DNA, 24 bp, Homo sapiens
acaatgttggggtcagagattgtc

SEQ ID NO: 31478 - DNA, 24 bp, Homo sapiens
aacaatgttggggtcagagattgt

SEQ ID NO: 31479 - DNA, 24 bp, Homo sapiens
caacaatgttggggtcagagattg

SEQ ID NO: 31480 - DNA, 24 bp, Homo sapiens
cattgaaggaaacatgaagttgca

SEQ ID NO: 31481 - DNA, 24 bp, Homo sapiens
acattgaaggaaacatgaagttgc

SEQ ID NO: 31482 - DNA, 24 bp, Homo sapiens
cacattgaaggaaacatgaagttg

SEQ ID NO: 31483 - DNA, 24 bp, Homo sapiens
ctctgccgccgccaccacgcctca

SEQ ID NO: 31484 - DNA, 24 bp, Homo sapiens
tggccagtgcccatagctagagta

SEQ ID NO: 31485 - DNA, 24 bp, Homo sapiens
agcgcccaggagggctcggcggcc

SEQ ID NO: 31486 - DNA, 24 bp, Homo sapiens
tcggccagctgaattactttccta

SEQ ID NO: 31487 - DNA, 24 bp, Homo sapiens
atcggccagctgaattactttcct

SEQ ID NO: 31488 - DNA, 24 bp, Homo sapiens
gatcggccagctgaattactttcc

SEQ ID NO: 31489 - DNA, 24 bp, Homo sapiens
cattgggttctgctgggctcagta

SEQ ID NO: 31490 - DNA, 24 bp, Homo sapiens
aatacacaacaaggacgaacatct

SEQ ID NO: 31491 - DNA, 24 bp, Homo sapiens
tctgtttgaatggcgatgggttga

SEQ ID NO: 31492 - DNA, 24 bp, Homo sapiens
acagaccaggacctcctcagatgc

SEQ ID NO: 31493 - DNA, 25 bp, Homo sapiens
ttgagacacgattccaagtggacaa

SEQ ID NO: 31494 - DNA, 25 bp, Homo sapiens
cgagaagataacaacaccaacaggc

SEQ ID NO: 31495 - DNA, 25 bp, Homo sapiens
gcacatggcagacactatcgaggag

SEQ ID NO: 31496 - DNA, 25 bp, Homo sapiens
tgaccacactcaacatccagtacgg

SEQ ID NO: 31497 - DNA, 24 bp, Homo sapiens
ggaagagcaccatcgtcaagcaga

SEQ ID NO: 31498 - DNA, 24 bp, Homo sapiens
tggccacactgtgccctgtgggac

SEQ ID NO: 31499 - DNA, 24 bp, Homo sapiens
ctggccacactgtgccctgtggga

SEQ ID NO: 31500 - DNA, 24 bp, Homo sapiens
cctggccacactgtgccctgtggg

SEQ ID NO: 31501 - DNA, 24 bp, Homo sapiens
acctctcatctgacgactgacagc

SEQ ID NO: 31502 - DNA, 24 bp, Homo sapiens
gtctgcttgcccagcgtggtaaga

SEQ ID NO: 31503 - DNA, 24 bp, Homo sapiens
cgggtgacctcaaagcagaagctc

SEQ ID NO: 31504 - DNA, 24 bp, Homo sapiens
aatcaccgtcttctgcgtcgctcg

SEQ ID NO: 31505 - DNA, 24 bp, Homo sapiens
ggctcctccacaattatgatcctc

SEQ ID NO: 31506 - DNA, 24 bp, Homo sapiens
gtagaccggagctgttcctattcg

SEQ ID NO: 31507 - DNA, 24 bp, Homo sapiens
ggcgaagcggggccatctgcttta

SEQ ID NO: 31508 - DNA, 24 bp, Homo sapiens
aggcgaagcggggccatctgcttt

SEQ ID NO: 31509 - DNA, 24 bp, Homo sapiens
caggcgaagcggggccatctgctt

SEQ ID NO: 31510 - DNA, 24 bp, Homo sapiens
catctgtgaagcctgggcagagaa

SEQ ID NO: 31511 - DNA, 24 bp, Homo sapiens
acatctgtgaagcctgggcagaga

SEQ ID NO: 31512 - DNA, 24 bp, Homo sapiens
gacatctgtgaagcctgggcagag

SEQ ID NO: 31513 - DNA, 24 bp, Homo sapiens
atatttttcaggaaagtctgattg

SEQ ID NO: 31514 - DNA, 24 bp, Homo sapiens
tatatttttcaggaaagtctgatt

SEQ ID NO: 31515 - DNA, 24 bp, Homo sapiens
atatatttttcaggaaagtctgat

SEQ ID NO: 31516 - DNA, 24 bp, Homo sapiens
caggaccacagttatacatcttca

SEQ ID NO: 31517 - DNA, 24 bp, Homo sapiens
gcaggaccacagttatacatcttc

SEQ ID NO: 31518 - DNA, 24 bp, Homo sapiens
tgcaggaccacagttatacatctt

SEQ ID NO: 31519 - DNA, 24 bp, Homo sapiens
tacaggagctcgtaagtgcttatt

SEQ ID NO: 31520 - DNA, 24 bp, Homo sapiens
atacaggagctcgtaagtgcttat

SEQ ID NO: 31521 - DNA, 24 bp, Homo sapiens
gatacaggagctcgtaagtgctta

SEQ ID NO: 31522 - DNA, 24 bp, Homo sapiens
gcttgtcgcagaccataaagcaga

SEQ ID NO: 31523 - DNA, 24 bp, Homo sapiens
ggcttgtcgcagaccataaagcag

SEQ ID NO: 31524 - DNA, 24 bp, Homo sapiens
gggcttgtcgcagaccataaagca

SEQ ID NO: 31525 - DNA, 24 bp, Homo sapiens
gccgacttgtcttcattccaggtg

SEQ ID NO: 31526 - DNA, 24 bp, Homo sapiens
cgaagctgtccactgccaccactc

SEQ ID NO: 31527 - DNA, 24 bp, Homo sapiens
gtgtcgggtggttcgtgggaagtc

SEQ ID NO: 31528 - DNA, 24 bp, Homo sapiens
atgtaatgaaagtaagaataattc

SEQ ID NO: 31529 - DNA, 24 bp, Homo sapiens
gatgtaatgaaagtaagaataatt

SEQ ID NO: 31530 - DNA, 24 bp, Homo sapiens
tgatgtaatgaaagtaagaataat

SEQ ID NO: 31531 - DNA, 24 bp, Homo sapiens
agttccaacaagctaagaaatggc

SEQ ID NO: 31532 - DNA, 24 bp, Homo sapiens
gagttccaacaagctaagaaatgg

SEQ ID NO: 31533 - DNA, 24 bp, Homo sapiens
ggagttccaacaagctaagaaatg

SEQ ID NO: 31534 - DNA, 24 bp, Homo sapiens
tggaggaggagcaacaggaagtgg

SEQ ID NO: 31535 - DNA, 24 bp, Homo sapiens
agcctccttccagagaagctcagc

SEQ ID NO: 31536 - DNA, 24 bp, Homo sapiens
aaacacatctgaatttgatatcct

SEQ ID NO: 31537 - DNA, 24 bp, Homo sapiens
ttaagtgatctgcccacctcagcc

SEQ ID NO: 31538 - DNA, 24 bp, Homo sapiens
ctgtcactcaggctagagtgcagt

SEQ ID NO: 31539 - DNA, 24 bp, Homo sapiens
gtccagcttattttttgagacaag

SEQ ID NO: 31540 - DNA, 24 bp, Homo sapiens
aacaaaacgaaagtgcttctcatc

SEQ ID NO: 31541 - DNA, 24 bp, Homo sapiens
aaacaaaacgaaagtgcttctcat

SEQ ID NO: 31542 - DNA, 24 bp, Homo sapiens
aaaacaaaacgaaagtgcttctca

SEQ ID NO: 31543 - DNA, 24 bp, Homo sapiens
aacaaaacgaagaaaatagctttt

SEQ ID NO: 31544 - DNA, 24 bp, Homo sapiens
aaacaaaacgaagaaaatagcttt

SEQ ID NO: 31545 - DNA, 24 bp, Homo sapiens
aaaacaaaacgaagaaaatagctt

SEQ ID NO: 31546 - DNA, 25 bp, Homo sapiens
agtatgtgatctacggcatcgcagc

SEQ ID NO: 31547 - DNA, 25 bp, Homo sapiens
caagaactgctggagacacactgga

SEQ ID NO: 31548 - DNA, 23 bp, Homo sapiens
cctgttctgtggctgcggtcatg

SEQ ID NO: 31549 - DNA, 24 bp, Homo sapiens
ctttttgttgggaatcataaccat

SEQ ID NO: 31550 - DNA, 24 bp, Homo sapiens
actttttgttgggaatcataacca

SEQ ID NO: 31551 - DNA, 24 bp, Homo sapiens
aactttttgttgggaatcataacc

SEQ ID NO: 31552 - DNA, 23 bp, Homo sapiens
gaatgattggtccagtcattggc

SEQ ID NO: 31553 - DNA, 23 bp, Homo sapiens
ctgggatctctgtttgctaaaat

SEQ ID NO: 31554 - DNA, 23 bp, Homo sapiens
ggatattggatatgtagatctga

SEQ ID NO: 31555 - DNA, 23 bp, Homo sapiens
gtggtgctggtgactttggtgct

SEQ ID NO: 31556 - DNA, 23 bp, Homo sapiens
cccacttccaagcccaccacaac

SEQ ID NO: 31557 - DNA, 24 bp, Homo sapiens
ggacgccttggaagagtcactcaa

SEQ ID NO: 31558 - DNA, 24 bp, Homo sapiens
agactgtagaagtgagtattttgt

SEQ ID NO: 31559 - DNA, 24 bp, Homo sapiens
gagactgtagaagtgagtattttg

SEQ ID NO: 31560 - DNA, 24 bp, Homo sapiens
tgagactgtagaagtgagtatttt

SEQ ID NO: 31561 - DNA, 24 bp, Homo sapiens
ttgtggaaaagatcaaacaaatgg

SEQ ID NO: 31562 - DNA, 24 bp, Homo sapiens
cttgtggaaaagatcaaacaaatg

SEQ ID NO: 31563 - DNA, 24 bp, Homo sapiens
gcttgtggaaaagatcaaacaaat

SEQ ID NO: 31564 - DNA, 23 bp, Homo sapiens
ctcggtcggtcattcaaggctcc

SEQ ID NO: 31565 - DNA, 25 bp, Homo sapiens
tcttctcatctcctatctccgcctg

SEQ ID NO: 31566 - DNA, 24 bp, Homo sapiens
aacgatcctctcacctcagcctcc

SEQ ID NO: 31567 - DNA, 24 bp, Homo sapiens
acttccgactctggcagcactaca

SEQ ID NO: 31568 - DNA, 24 bp, Homo sapiens
cccgccagatgactcctgtaaccc

SEQ ID NO: 31569 - DNA, 24 bp, Homo sapiens
cttcctcttccaccaccaccacca

SEQ ID NO: 31570 - DNA, 24 bp, Homo sapiens
cctgcctcctccagccacaccgag

SEQ ID NO: 31571 - DNA, 24 bp, Homo sapiens
tcagaaatcgcaatggatgaaggg

SEQ ID NO: 31572 - DNA, 23 bp, Homo sapiens
acctggtcacctgtctggagcaa

SEQ ID NO: 31573 - DNA, 25 bp, Homo sapiens
aaatcgtttctgagaagcctgggtt

SEQ ID NO: 31574 - DNA, 25 bp, Homo sapiens
tcttctgtcccatgctctctaacga

SEQ ID NO: 31575 - DNA, 25 bp, Homo sapiens
ccgacaggaataggcagaagcagaa

SEQ ID NO: 31576 - DNA, 23 bp, Homo sapiens
gctggagtgaagtggcgtgacct

SEQ ID NO: 31577 - DNA, 23 bp, Homo sapiens
ctacaccgccaccctcgtcccag

SEQ ID NO: 31578 - DNA, 23 bp, Homo sapiens
gctgctgtggctgtgcgacctgc

SEQ ID NO: 31579 - DNA, 24 bp, Homo sapiens
acccgtagctaagacgccaggatt

SEQ ID NO: 31580 - DNA, 23 bp, Homo sapiens
aactgctcccccgtactctgctc

SEQ ID NO: 31581 - DNA, 24 bp, Homo sapiens
gcggctctggaagtcggtttagtg

SEQ ID NO: 31582 - DNA, 24 bp, Homo sapiens
aggctgaggacctgcgacttggtg

SEQ ID NO: 31583 - DNA, 24 bp, Homo sapiens
ccagggagcagagaggcagagtac

SEQ ID NO: 31584 - DNA, 24 bp, Homo sapiens
gtggccagcaggtcttggaaacgc

SEQ ID NO: 31585 - DNA, 24 bp, Homo sapiens
tgtggccagcaggtcttggaaacg

SEQ ID NO: 31586 - DNA, 24 bp, Homo sapiens
ctgtggccagcaggtcttggaaac

SEQ ID NO: 31587 - DNA, 24 bp, Homo sapiens
cgcagccacagcgcccggcagaat

SEQ ID NO: 31588 - DNA, 24 bp, Homo sapiens
ccgcagccacagcgcccggcagaa

SEQ ID NO: 31589 - DNA, 24 bp, Homo sapiens
cccgcagccacagcgcccggcaga

SEQ ID NO: 31590 - DNA, 23 bp, Homo sapiens
gagagccagccctgacgtgaact

SEQ ID NO: 31591 - DNA, 23 bp, Homo sapiens
gaggaaagccacgagcactgagc

SEQ ID NO: 31592 - DNA, 23 bp, Homo sapiens
tagggtcgggtccagtgtgcggt

SEQ ID NO: 31593 - DNA, 24 bp, Homo sapiens
tcctattgtagggaaaccaataag

SEQ ID NO: 31594 - DNA, 24 bp, Homo sapiens
ttcctattgtagggaaaccaataa

SEQ ID NO: 31595 - DNA, 24 bp, Homo sapiens
tttcctattgtagggaaaccaata

SEQ ID NO: 31596 - DNA, 25 bp, Homo sapiens
ctacatgcacatcttcctagcgggc

SEQ ID NO: 31597 - DNA, 25 bp, Homo sapiens
ctcctgggcttcttcaagggaatga

SEQ ID NO: 31598 - DNA, 23 bp, Homo sapiens
tgctcacggccacctcccaccag

SEQ ID NO: 31599 - DNA, 25 bp, Homo sapiens
tgtggtcaactctgtcctgtttggg

SEQ ID NO: 31600 - DNA, 25 bp, Homo sapiens
ctacatgcacatcttcctagcgggc

SEQ ID NO: 31601 - DNA, 23 bp, Homo sapiens
tgctcacggccacctcccaccag

SEQ ID NO: 31602 - DNA, 24 bp, Homo sapiens
tatggaaatgagtaagtagcacag

SEQ ID NO: 31603 - DNA, 24 bp, Homo sapiens
ctatggaaatgagtaagtagcaca

SEQ ID NO: 31604 - DNA, 24 bp, Homo sapiens
gctatggaaatgagtaagtagcac

SEQ ID NO: 31605 - DNA, 23 bp, Homo sapiens
cggcagcaggagcagagtgtctt

SEQ ID NO: 31606 - DNA, 23 bp, Homo sapiens
cctgatagcagatagcgggcagc

SEQ ID NO: 31607 - DNA, 23 bp, Homo sapiens
gcacaggcacactgaccatccaa

SEQ ID NO: 31608 - DNA, 25 bp, Homo sapiens
agtgctatgtgttggtatcaatggc

SEQ ID NO: 31609 - DNA, 25 bp, Homo sapiens
tcttatgtgggatgtatgactcagc

SEQ ID NO: 31610 - DNA, 23 bp, Homo sapiens
actgtggtgggcaacttgggctt

SEQ ID NO: 31611 - DNA, 24 bp, Homo sapiens
tgagcctgctgaactggaattatg

SEQ ID NO: 31612 - DNA, 24 bp, Homo sapiens
ctgagcctgctgaactggaattat

SEQ ID NO: 31613 - DNA, 24 bp, Homo sapiens
cctgagcctgctgaactggaatta

SEQ ID NO: 31614 - DNA, 25 bp, Homo sapiens
atcaaatctacagacaagcccacgc

SEQ ID NO: 31615 - DNA, 23 bp, Homo sapiens
ggagtctcactttgtcgcccagg

SEQ ID NO: 31616 - DNA, 23 bp, Homo sapiens
gtggcacaatctctgctcactgc

SEQ ID NO: 31617 - DNA, 24 bp, Homo sapiens
tggaactacagggcatggactgga

SEQ ID NO: 31618 - DNA, 24 bp, Homo sapiens
atggaactacagggcatggactgg

SEQ ID NO: 31619 - DNA, 24 bp, Homo sapiens
gatggaactacagggcatggactg

SEQ ID NO: 31620 - DNA, 23 bp, Homo sapiens
cgccctcggaaatctcactgtcg

SEQ ID NO: 31621 - DNA, 25 bp, Homo sapiens
aatcacaccacgcacaacttctatt

SEQ ID NO: 31622 - DNA, 24 bp, Homo sapiens
gcaaagaaccagtgtgactccagt

SEQ ID NO: 31623 - DNA, 25 bp, Homo sapiens
aatcacaccacgcacaacttctatt

SEQ ID NO: 31624 - DNA, 24 bp, Homo sapiens
gcaaagaaccagtgtgactccagt

SEQ ID NO: 31625 - DNA, 25 bp, Homo sapiens
aattgtgaattagcgaagaactcta

SEQ ID NO: 31626 - DNA, 24 bp, Homo sapiens
agagtctattggttttctctgtgg

SEQ ID NO: 31627 - DNA, 24 bp, Homo sapiens
aagagtctattggttttctctgtg

SEQ ID NO: 31628 - DNA, 24 bp, Homo sapiens
gaagagtctattggttttctctgt

SEQ ID NO: 31629 - DNA, 25 bp, Homo sapiens
gaaagagaaagtcagcctgctacgg

SEQ ID NO: 31630 - DNA, 24 bp, Homo sapiens
ctgaatacacggctgcgggatgac

SEQ ID NO: 31631 - DNA, 23 bp, Homo sapiens
cacctgctgctgctgctgttgct

SEQ ID NO: 31632 - DNA, 25 bp, Homo sapiens
tggcataagcacgatgtggagaagt

SEQ ID NO: 31633 - DNA, 25 bp, Homo sapiens
agtggacagtagaggacaaggtgct

SEQ ID NO: 31634 - DNA, 25 bp, Homo sapiens
agatgctgcctgacaagttgattcc

SEQ ID NO: 31635 - DNA, 24 bp, Homo sapiens
tttgccttcagccataactgtaag

SEQ ID NO: 31636 - DNA, 24 bp, Homo sapiens
ctttgccttcagccataactgtaa

SEQ ID NO: 31637 - DNA, 24 bp, Homo sapiens
tctttgccttcagccataactgta

SEQ ID NO: 31638 - DNA, 25 bp, Homo sapiens
agttctttaggacgggcacgatagc

SEQ ID NO: 31639 - DNA, 23 bp, Homo sapiens
aaggtgggaggattgcttgagct

SEQ ID NO: 31640 - DNA, 23 bp, Homo sapiens
gtgagccatgacggtgccactgc

SEQ ID NO: 31641 - DNA, 23 bp, Homo sapiens
gcttgggtgacagagtgagacgc

SEQ ID NO: 31642 - DNA, 23 bp, Homo sapiens
gtgagccatgacggtgccactgc

SEQ ID NO: 31643 - DNA, 25 bp, Homo sapiens
agttctttaggacgggcacgatagc

SEQ ID NO: 31644 - DNA, 23 bp, Homo sapiens
ggctgtggctctgctctggctgc

SEQ ID NO: 31645 - DNA, 23 bp, Homo sapiens
tctggttggatgacatgcggtgc

SEQ ID NO: 31646 - DNA, 23 bp, Homo sapiens
ggacacaaggaagatgctggcgt

SEQ ID NO: 31647 - DNA, 24 bp, Homo sapiens
acctcagctctgtaaataatctga

SEQ ID NO: 31648 - DNA, 24 bp, Homo sapiens
aacctcagctctgtaaataatctg

SEQ ID NO: 31649 - DNA, 24 bp, Homo sapiens
gaacctcagctctgtaaataatct

SEQ ID NO: 31650 - DNA, 25 bp, Homo sapiens
ggagaataggagccagaacctgagc

SEQ ID NO: 31651 - DNA, 23 bp, Homo sapiens
gtgggtcgtcttgggctgggtag

SEQ ID NO: 31652 - DNA, 23 bp, Homo sapiens
tgagcaggagcagaaccattacc

SEQ ID NO: 31653 - DNA, 23 bp, Homo sapiens
aacctcacctactccgtctgccg

SEQ ID NO: 31654 - DNA, 23 bp, Homo sapiens
cctctccgtgctctgcctggtgg

SEQ ID NO: 31655 - DNA, 23 bp, Homo sapiens
catccacgccaacctgtccttcg

SEQ ID NO: 31656 - DNA, 24 bp, Homo sapiens
gtgcattttaggcaataattctaa

SEQ ID NO: 31657 - DNA, 24 bp, Homo sapiens
tgtgcattttaggcaataattcta

SEQ ID NO: 31658 - DNA, 24 bp, Homo sapiens
atgtgcattttaggcaataattct

SEQ ID NO: 31659 - DNA, 24 bp, Homo sapiens
ttattttctagctaattcaaggta

SEQ ID NO: 31660 - DNA, 24 bp, Homo sapiens
tttattttctagctaattcaaggt

SEQ ID NO: 31661 - DNA, 24 bp, Homo sapiens
ttttattttctagctaattcaagg

SEQ ID NO: 31662 - DNA, 24 bp, Homo sapiens
taccacatcagatgctgtctttgc

SEQ ID NO: 31663 - DNA, 24 bp, Homo sapiens
gtaccacatcagatgctgtctttg

SEQ ID NO: 31664 - DNA, 24 bp, Homo sapiens
agtaccacatcagatgctgtcttt

SEQ ID NO: 31665 - DNA, 24 bp, Homo sapiens
aattcagacctgccaagaccacgg

SEQ ID NO: 31666 - DNA, 24 bp, Homo sapiens
gcctgtcagcagttctccaagcag

SEQ ID NO: 31667 - DNA, 24 bp, Homo sapiens
tgattctcctgcctcagcctcctg

SEQ ID NO: 31668 - DNA, 23 bp, Homo sapiens
ctactcggaaggctgaggcagga

SEQ ID NO: 31669 - DNA, 25 bp, Homo sapiens
gctaggagaatgaagtgtggtgttg

SEQ ID NO: 31670 - DNA, 25 bp, Homo sapiens
cctgggcgtatctcttcttcctctg

SEQ ID NO: 31671 - DNA, 24 bp, Homo sapiens
tttctgtttagaatgttagaagag

SEQ ID NO: 31672 - DNA, 24 bp, Homo sapiens
ttttctgtttagaatgttagaaga

SEQ ID NO: 31673 - DNA, 24 bp, Homo sapiens
tttttctgtttagaatgttagaag

SEQ ID NO: 31674 - DNA, 24 bp, Homo sapiens
gggcagaaattgaaactgaaactg

SEQ ID NO: 31675 - DNA, 24 bp, Homo sapiens
agggcagaaattgaaactgaaact

SEQ ID NO: 31676 - DNA, 24 bp, Homo sapiens
tagggcagaaattgaaactgaaac

SEQ ID NO: 31677 - DNA, 24 bp, Homo sapiens
tgacattctgaatcaagtgctgct

SEQ ID NO: 31678 - DNA, 24 bp, Homo sapiens
tcacacagacagaatttccagcca

SEQ ID NO: 31679 - DNA, 24 bp, Homo sapiens
acatctccagccctgaatactcat

SEQ ID NO: 31680 - DNA, 24 bp, Homo sapiens
gctgctccttgccttctgccataa

SEQ ID NO: 31681 - DNA, 24 bp, Homo sapiens
ttgcctgctgccatccatgtaaga

SEQ ID NO: 31682 - DNA, 24 bp, Homo sapiens
tgatgtttcagagaacccaactca

SEQ ID NO: 31683 - DNA, 24 bp, Homo sapiens
tttcagataaggtaaatacctacc

SEQ ID NO: 31684 - DNA, 24 bp, Homo sapiens
ctttcagataaggtaaatacctac

SEQ ID NO: 31685 - DNA, 24 bp, Homo sapiens
tctttcagataaggtaaataccta

SEQ ID NO: 31686 - DNA, 23 bp, Homo sapiens
cttgcccagttcccgaagcgaag

SEQ ID NO: 31687 - DNA, 23 bp, Homo sapiens
agcccacaactttgcagcctcgg

SEQ ID NO: 31688 - DNA, 23 bp, Homo sapiens
cccgctccctcctccccacatcc

SEQ ID NO: 31689 - DNA, 24 bp, Homo sapiens
gcctgcttatgtcttccatagcca

SEQ ID NO: 31690 - DNA, 24 bp, Homo sapiens
cgctgtcacctcgtctctacttag

SEQ ID NO: 31691 - DNA, 24 bp, Homo sapiens
tgcctctccctccacacctccctg

SEQ ID NO: 31692 - DNA, 23 bp, Homo sapiens
cccagcaccagagcccgagttct

SEQ ID NO: 31693 - DNA, 25 bp, Homo sapiens
tcaactgccctgaacttggataagc

SEQ ID NO: 31694 - DNA, 23 bp, Homo sapiens
ttgttgctgccttggtttcccga

SEQ ID NO: 31695 - DNA, 23 bp, Homo sapiens
catcggaggcgtctgcggtgttg

SEQ ID NO: 31696 - DNA, 23 bp, Homo sapiens
ctctcaggcaggcagacccaggg

SEQ ID NO: 31697 - DNA, 23 bp, Homo sapiens
cgccacaccttgttcatggattt

SEQ ID NO: 31698 - DNA, 23 bp, Homo sapiens
accaagatgagtgccacgtcctg

SEQ ID NO: 31699 - DNA, 23 bp, Homo sapiens
tcatcttcgtggggcgtgaggag

SEQ ID NO: 31700 - DNA, 23 bp, Homo sapiens
cggcgcccgccaccggctccctc

SEQ ID NO: 31701 - DNA, 23 bp, Homo sapiens
ctaacctcaagtgagccgcctgc

SEQ ID NO: 31702 - DNA, 25 bp, Homo sapiens
gctttggacacactttaataaatgc

SEQ ID NO: 31703 - DNA, 25 bp, Homo sapiens
acaataaagtcagtatttgaaagga

SEQ ID NO: 31704 - DNA, 25 bp, Homo sapiens
gcctgatgtctttcaaatgggagag

SEQ ID NO: 31705 - DNA, 23 bp, Homo sapiens
ctagtgctgtggtctgtggcaaa

SEQ ID NO: 31706 - DNA, 25 bp, Homo sapiens
ccagactttgtccaacatttattcc

SEQ ID NO: 31707 - DNA, 24 bp, Homo sapiens
atgtacaacagtaaattggtaatt

SEQ ID NO: 31708 - DNA, 24 bp, Homo sapiens
aatgtacaacagtaaattggtaat

SEQ ID NO: 31709 - DNA, 24 bp, Homo sapiens
aaatgtacaacagtaaattggtaa

SEQ ID NO: 31710 - DNA, 24 bp, Homo sapiens
ccaccaccaccccaccatctctat

SEQ ID NO: 31711 - DNA, 25 bp, Homo sapiens
aacacctcatcttccatcttcctgc

SEQ ID NO: 31712 - DNA, 24 bp, Homo sapiens
acaccatccgctgtaatcctgttg

SEQ ID NO: 31713 - DNA, 24 bp, Homo sapiens
gcaagatttcatcccaccctcctg

SEQ ID NO: 31714 - DNA, 23 bp, Homo sapiens
ttccactgaggtccacgaaggtg

SEQ ID NO: 31715 - DNA, 23 bp, Homo sapiens
gaaggcaggcgaggagagcagtc

SEQ ID NO: 31716 - DNA, 24 bp, Homo sapiens
tcctcatctgtgttctcatcttga

SEQ ID NO: 31717 - DNA, 25 bp, Homo sapiens
gctgtaggtgttggcatagccttga

SEQ ID NO: 31718 - DNA, 23 bp, Homo sapiens
atctggaccaaaaatcaatgact

SEQ ID NO: 31719 - DNA, 24 bp, Homo sapiens
tgcactccagcctcctggtccgcg

SEQ ID NO: 31720 - DNA, 24 bp, Homo sapiens
ttgcactccagcctcctggtccgc

SEQ ID NO: 31721 - DNA, 24 bp, Homo sapiens
attgcactccagcctcctggtccg

SEQ ID NO: 31722 - DNA, 23 bp, Homo sapiens
ctcaggaccagcaccagccaagg

SEQ ID NO: 31723 - DNA, 23 bp, Homo sapiens
ccgctggtcaatgcctccttcaa

SEQ ID NO: 31724 - DNA, 25 bp, Homo sapiens
tgtccaacatgacctacaaggagga

SEQ ID NO: 31725 - DNA, 24 bp, Homo sapiens
ggggcgatcaggataggcctcctc

SEQ ID NO: 31726 - DNA, 24 bp, Homo sapiens
tggggcgatcaggataggcctcct

SEQ ID NO: 31727 - DNA, 24 bp, Homo sapiens
atggggcgatcaggataggcctcc

SEQ ID NO: 31728 - DNA, 23 bp, Homo sapiens
cacccttcactgccacctcgctg

SEQ ID NO: 31729 - DNA, 23 bp, Homo sapiens
aagaccgaaagggcgagggacat

SEQ ID NO: 31730 - DNA, 25 bp, Homo sapiens
gcttgctcactatgtgctcctctga

SEQ ID NO: 31731 - DNA, 24 bp, Homo sapiens
gggaggccatgagcggctttatgg

SEQ ID NO: 31732 - DNA, 24 bp, Homo sapiens
agggaggccatgagcggctttatg

SEQ ID NO: 31733 - DNA, 24 bp, Homo sapiens
cagggaggccatgagcggctttat

SEQ ID NO: 31734 - DNA, 24 bp, Homo sapiens
cacctggggatagcccgtgccaag

SEQ ID NO: 31735 - DNA, 24 bp, Homo sapiens
ccacctggggatagcccgtgccaa

SEQ ID NO: 31736 - DNA, 24 bp, Homo sapiens
gccacctggggatagcccgtgcca

SEQ ID NO: 31737 - DNA, 24 bp, Homo sapiens
atactacaaagctgagaaattatc

SEQ ID NO: 31738 - DNA, 24 bp, Homo sapiens
catactacaaagctgagaaattat

SEQ ID NO: 31739 - DNA, 24 bp, Homo sapiens
ccatactacaaagctgagaaatta

SEQ ID NO: 31740 - DNA, 25 bp, Homo sapiens
tggttgtgacgaagactgtggatgc

SEQ ID NO: 31741 - DNA, 25 bp, Homo sapiens
ggcggactggatgtattgtctcaag

SEQ ID NO: 31742 - DNA, 25 bp, Homo sapiens
gctcatttattggactcactcttgc

SEQ ID NO: 31743 - DNA, 23 bp, Homo sapiens
gccacctaagctctgcacaagga

SEQ ID NO: 31744 - DNA, 23 bp, Homo sapiens
acttgcgagccctggtcagagag

SEQ ID NO: 31745 - DNA, 23 bp, Homo sapiens
gtggcaggtgagcggtgatgaag

SEQ ID NO: 31746 - DNA, 25 bp, Homo sapiens
gccacctaagctctgcacaaggaat

SEQ ID NO: 31747 - DNA, 23 bp, Homo sapiens
acttgcgagccctggtcagagag

SEQ ID NO: 31748 - DNA, 23 bp, Homo sapiens
gtggcaggtgagcggtgatgaag

SEQ ID NO: 31749 - DNA, 25 bp, Homo sapiens
tggttgttctcagtcttattattaa

SEQ ID NO: 31750 - DNA, 25 bp, Homo sapiens
aaatgataaaccttgcctctgatga

SEQ ID NO: 31751 - DNA, 25 bp, Homo sapiens
accttctaataaaagagactttcct

SEQ ID NO: 31752 - DNA, 25 bp, Homo sapiens
atgactggaagatgctacgaaaccg

SEQ ID NO: 31753 - DNA, 25 bp, Homo sapiens
cacttgtggtggaggagtacctgga

SEQ ID NO: 31754 - DNA, 23 bp, Homo sapiens
cctgtggtggatggtgtggtgat

SEQ ID NO: 31755 - DNA, 23 bp, Homo sapiens
gcgagaaagtggtgctggtgttt

SEQ ID NO: 31756 - DNA, 24 bp, Homo sapiens
gcttcagcgaggactgtctgtacc

SEQ ID NO: 31757 - DNA, 23 bp, Homo sapiens
ggttcaagcgagtctcctgcctc

SEQ ID NO: 31758 - DNA, 24 bp, Homo sapiens
gtgtacctggggcaggaaatgatg

SEQ ID NO: 31759 - DNA, 24 bp, Homo sapiens
tgtgtacctggggcaggaaatgat

SEQ ID NO: 31760 - DNA, 24 bp, Homo sapiens
atgtgtacctggggcaggaaatga

SEQ ID NO: 31761 - DNA, 25 bp, Homo sapiens
cagtgatgatggtggagaacagccg

SEQ ID NO: 31762 - DNA, 23 bp, Homo sapiens
ctgttccgcaagcagccgttcct

SEQ ID NO: 31763 - DNA, 24 bp, Homo sapiens
ctgctctactacaccatccaccgc

SEQ ID NO: 31764 - DNA, 24 bp, Homo sapiens
tggaattacaggaagctaaagaat

SEQ ID NO: 31765 - DNA, 24 bp, Homo sapiens
ctggaattacaggaagctaaagaa

SEQ ID NO: 31766 - DNA, 24 bp, Homo sapiens
gctggaattacaggaagctaaaga

SEQ ID NO: 31767 - DNA, 24 bp, Homo sapiens
gcaacagatgaaggacggaggata

SEQ ID NO: 31768 - DNA, 24 bp, Homo sapiens
agtgcaatggcgtgatctcagctc

SEQ ID NO: 31769 - DNA, 24 bp, Homo sapiens
gcccaaactgtatctgttacctga

SEQ ID NO: 31770 - DNA, 24 bp, Homo sapiens
ctgctgctgcttctgctcctgctg

SEQ ID NO: 31771 - DNA, 24 bp, Homo sapiens
gctcctctcctgctgccctcgtgg

SEQ ID NO: 31772 - DNA, 24 bp, Homo sapiens
ggctgcgtcgctcaccctatctgt

SEQ ID NO: 31773 - DNA, 23 bp, Homo sapiens
ggtctgcttcctccgcctgatgg

SEQ ID NO: 31774 - DNA, 23 bp, Homo sapiens
ctgcggctgctggtggatacctc

SEQ ID NO: 31775 - DNA, 23 bp, Homo sapiens
aggacacccaccacacccaggag

SEQ ID NO: 31776 - DNA, 24 bp, Homo sapiens
cccattcccttctgactacctggc

SEQ ID NO: 31777 - DNA, 23 bp, Homo sapiens
ctgcccgagcccagtcccctgag

SEQ ID NO: 31778 - DNA, 24 bp, Homo sapiens
tgcggaggctggactggagtgaca

SEQ ID NO: 31779 - DNA, 24 bp, Homo sapiens
atgcggaggctggactggagtgac

SEQ ID NO: 31780 - DNA, 24 bp, Homo sapiens
catgcggaggctggactggagtga

SEQ ID NO: 31781 - DNA, 24 bp, Homo sapiens
tgcggaggctgagtcttgctctgt

SEQ ID NO: 31782 - DNA, 24 bp, Homo sapiens
atgcggaggctgagtcttgctctg

SEQ ID NO: 31783 - DNA, 24 bp, Homo sapiens
catgcggaggctgagtcttgctct

SEQ ID NO: 31784 - DNA, 24 bp, Homo sapiens
tgcggaggctggtgtggtgtcaca

SEQ ID NO: 31785 - DNA, 24 bp, Homo sapiens
atgcggaggctggtgtggtgtcac

SEQ ID NO: 31786 - DNA, 24 bp, Homo sapiens
catgcggaggctggtgtggtgtca

SEQ ID NO: 31787 - DNA, 23 bp, Homo sapiens
atgcggaggctggactggagtga

SEQ ID NO: 31788 - DNA, 25 bp, Homo sapiens
ttgttgaagtggtcagcctatggtt

SEQ ID NO: 31789 - DNA, 23 bp, Homo sapiens
caggagagtgtgctcgcaacgcc

SEQ ID NO: 31790 - DNA, 23 bp, Homo sapiens
cgcaagtaccaggccaactcggg

SEQ ID NO: 31791 - DNA, 23 bp, Homo sapiens
atgtggttccgcacctacatgtg

SEQ ID NO: 31792 - DNA, 23 bp, Homo sapiens
tgctgcccgtgccccaccccatc

SEQ ID NO: 31793 - DNA, 24 bp, Homo sapiens
gtggagcgcctgggcagcttggtg

SEQ ID NO: 31794 - DNA, 24 bp, Homo sapiens
cgtggagcgcctgggcagcttggt

SEQ ID NO: 31795 - DNA, 24 bp, Homo sapiens
gcgtggagcgcctgggcagcttgg

SEQ ID NO: 31796 - DNA, 24 bp, Homo sapiens
ttccaaccaaggtccattaataag

SEQ ID NO: 31797 - DNA, 24 bp, Homo sapiens
attccaaccaaggtccattaataa

SEQ ID NO: 31798 - DNA, 24 bp, Homo sapiens
gattccaaccaaggtccattaata

SEQ ID NO: 31799 - DNA, 23 bp, Homo sapiens
cctgccacgccgcccaacttccc

SEQ ID NO: 31800 - DNA, 23 bp, Homo sapiens
atgttctccaagctccgcgcctc

SEQ ID NO: 31801 - DNA, 23 bp, Homo sapiens
cagagcagcaacagccccatgac

SEQ ID NO: 31802 - DNA, 24 bp, Homo sapiens
aatataaaatgggttttggaaatc

SEQ ID NO: 31803 - DNA, 24 bp, Homo sapiens
gaatataaaatgggttttggaaat

SEQ ID NO: 31804 - DNA, 24 bp, Homo sapiens
ggaatataaaatgggttttggaaa

SEQ ID NO: 31805 - DNA, 24 bp, Homo sapiens
aatataaaatggtaagatgcaaga

SEQ ID NO: 31806 - DNA, 24 bp, Homo sapiens
gaatataaaatggtaagatgcaag

SEQ ID NO: 31807 - DNA, 24 bp, Homo sapiens
ggaatataaaatggtaagatgcaa

SEQ ID NO: 31808 - DNA, 24 bp, Homo sapiens
agaccagccagaccaagtcagagt

SEQ ID NO: 31809 - DNA, 24 bp, Homo sapiens
tctctggtgttagaacttcaggca

SEQ ID NO: 31810 - DNA, 24 bp, Homo sapiens
agaccctgttcctggaagcagcag

SEQ ID NO: 31811 - DNA, 24 bp, Homo sapiens
gagggcaacaggtatgtcactggc

SEQ ID NO: 31812 - DNA, 24 bp, Homo sapiens
ggagggcaacaggtatgtcactgg

SEQ ID NO: 31813 - DNA, 24 bp, Homo sapiens
tggagggcaacaggtatgtcactg

SEQ ID NO: 31814 - DNA, 23 bp, Homo sapiens
cacgcctgtcatcccagcacttt

SEQ ID NO: 31815 - DNA, 25 bp, Homo sapiens
ccaaaagccaggagtaataccaaga

SEQ ID NO: 31816 - DNA, 23 bp, Homo sapiens
agctgggttcagaaggccgggtg

SEQ ID NO: 31817 - DNA, 24 bp, Homo sapiens
ttttttttgagatggagtctcact

SEQ ID NO: 31818 - DNA, 24 bp, Homo sapiens
tttttttttgagatggagtctcac

SEQ ID NO: 31819 - DNA, 24 bp, Homo sapiens
tttttttttgagatggagtctcac

SEQ ID NO: 31820 - DNA, 24 bp, Homo sapiens
ttttcccataggaatctgaacctg

SEQ ID NO: 31821 - DNA, 24 bp, Homo sapiens
attttcccataggaatctgaacct

SEQ ID NO: 31822 - DNA, 24 bp, Homo sapiens
tattttcccataggaatctgaacc

SEQ ID NO: 31823 - DNA, 24 bp, Homo sapiens
gttattaacacgtaagttttagct

SEQ ID NO: 31824 - DNA, 24 bp, Homo sapiens
agttattaacacgtaagttttagc

SEQ ID NO: 31825 - DNA, 24 bp, Homo sapiens
gagttattaacacgtaagttttag

SEQ ID NO: 31826 - DNA, 24 bp, Homo sapiens
ccaccccccagcctgcctcccctg

SEQ ID NO: 31827 - DNA, 24 bp, Homo sapiens
tccaccccccagcctgcctcccct

SEQ ID NO: 31828 - DNA, 24 bp, Homo sapiens
ctccaccccccagcctgcctcccc

SEQ ID NO: 31829 - DNA, 24 bp, Homo sapiens
aagtgctgagattacaggcgtgag

SEQ ID NO: 31830 - DNA, 24 bp, Homo sapiens
tttcctgtctttgtgggctgatgg

SEQ ID NO: 31831 - DNA, 24 bp, Homo sapiens
gttaggacgacagtctcgccaagg

SEQ ID NO: 31832 - DNA, 24 bp, Homo sapiens
ggctgtttctcttggaggtggtgc

SEQ ID NO: 31833 - DNA, 24 bp, Homo sapiens
acaaggtctcgctgtgttgctcat

SEQ ID NO: 31834 - DNA, 24 bp, Homo sapiens
ggaggatggcggatctgctacctt

SEQ ID NO: 31835 - DNA, 25 bp, Homo sapiens
gtggctaccctgctattcattgtgc

SEQ ID NO: 31836 - DNA, 24 bp, Homo sapiens
aagtatgtctccgatgccactgtg

SEQ ID NO: 31837 - DNA, 25 bp, Homo sapiens
ctgcttcttcctgctggtcatcctg

SEQ ID NO: 31838 - DNA, 25 bp, Homo sapiens
cctccaaatgccatcgtgttcacct

SEQ ID NO: 31839 - DNA, 23 bp, Homo sapiens
tgcctccatgtctcgctccatcg

SEQ ID NO: 31840 - DNA, 23 bp, Homo sapiens
gccaccaccaccttgttcctgcc

SEQ ID NO: 31841 - DNA, 23 bp, Homo sapiens
cgctcctgctgctgccactcgtc

SEQ ID NO: 31842 - DNA, 25 bp, Homo sapiens
tccaagttcaagtccttcgtgatct

SEQ ID NO: 31843 - DNA, 23 bp, Homo sapiens
gcgcgatggcctcggcgctgagc

SEQ ID NO: 31844 - DNA, 24 bp, Homo sapiens
agtcatccctctggctgtcacctc

SEQ ID NO: 31845 - DNA, 25 bp, Homo sapiens
ggtgtgcctacgtcatcatcctcat

SEQ ID NO: 31846 - DNA, 23 bp, Homo sapiens
tgctgctgccactcgtcattctg

SEQ ID NO: 31847 - DNA, 23 bp, Homo sapiens
ggacaccaacatgctgttcctgg

SEQ ID NO: 31848 - DNA, 23 bp, Homo sapiens
catcgtggccgtggctgtggagc

SEQ ID NO: 31849 - DNA, 23 bp, Homo sapiens
acctgcacaagaggatcgccctg

SEQ ID NO: 31850 - DNA, 24 bp, Homo sapiens
accagtcagaggggccgttcctcg

SEQ ID NO: 31851 - DNA, 24 bp, Homo sapiens
aaccagtcagaggggccgttcctc

SEQ ID NO: 31852 - DNA, 24 bp, Homo sapiens
aaaccagtcagaggggccgttcct

SEQ ID NO: 31853 - DNA, 23 bp, Homo sapiens
ctattctcctgcctcagcctcct

SEQ ID NO: 31854 - DNA, 25 bp, Homo sapiens
ggactgctctggactgacattgctc

SEQ ID NO: 31855 - DNA, 23 bp, Homo sapiens
tcatcaacagggagaaaccagcc

SEQ ID NO: 31856 - DNA, 23 bp, Homo sapiens
ctggtgctgagcctcctggacaa

SEQ ID NO: 31857 - DNA, 23 bp, Homo sapiens
gaggagcggcaggcggagatgga

SEQ ID NO: 31858 - DNA, 23 bp, Homo sapiens
gcacgccaccacgagcaatacgg

SEQ ID NO: 31859 - DNA, 23 bp, Homo sapiens
aggtggatgggctggagaacaac

SEQ ID NO: 31860 - DNA, 23 bp, Homo sapiens
ccttggcgtccttacagacctgc

SEQ ID NO: 31861 - DNA, 24 bp, Homo sapiens
gtccttcttgtggatggaaacggg

SEQ ID NO: 31862 - DNA, 23 bp, Homo sapiens
gcagcaccaggcccctctacatc

SEQ ID NO: 31863 - DNA, 23 bp, Homo sapiens
ggccacaggatgagcctggaggc

SEQ ID NO: 31864 - DNA, 23 bp, Homo sapiens
gcgcctgacttgctgctgctgca

SEQ ID NO: 31865 - DNA, 24 bp, Homo sapiens
ttatcttgcaggccaagaagacgc

SEQ ID NO: 31866 - DNA, 24 bp, Homo sapiens
tttatcttgcaggccaagaagacg

SEQ ID NO: 31867 - DNA, 24 bp, Homo sapiens
ctttatcttgcaggccaagaagac

SEQ ID NO: 31868 - DNA, 25 bp, Homo sapiens
gaactcctgacctcaagtgatccgc

SEQ ID NO: 31869 - DNA, 24 bp, Homo sapiens
gacctgaagtcctgaaggctcacc

SEQ ID NO: 31870 - DNA, 25 bp, Homo sapiens
atgatctcatgtcacggcaacctcc

SEQ ID NO: 31871 - DNA, 24 bp, Homo sapiens
agtgcctggcgaatcttgtgttcc

SEQ ID NO: 31872 - DNA, 24 bp, Homo sapiens
ctgtgaaaggtgtgctgacgggtt

SEQ ID NO: 31873 - DNA, 24 bp, Homo sapiens
ccattctgccgtgtgccatcttga

SEQ ID NO: 31874 - DNA, 24 bp, Homo sapiens
gcatctccactgaacaaccaaggc

SEQ ID NO: 31875 - DNA, 24 bp, Homo sapiens
tacaccagcagcctggccaccctc

SEQ ID NO: 31876 - DNA, 24 bp, Homo sapiens
cctgtccacattgatgtgggcggc

SEQ ID NO: 31877 - DNA, 24 bp, Homo sapiens
aatctcggctcaccacaaccactg

SEQ ID NO: 31878 - DNA, 24 bp, Homo sapiens
ggttcaagcgattctcctgcctca

SEQ ID NO: 31879 - DNA, 24 bp, Homo sapiens
ccttgccgtttgctggaatgatgt

SEQ ID NO: 31880 - DNA, 25 bp, Homo sapiens
cggagaacttgctcaacacagaggt

SEQ ID NO: 31881 - DNA, 23 bp, Homo sapiens
ggttctcccgacaggctcatttg

SEQ ID NO: 31882 - DNA, 23 bp, Homo sapiens
caccttcacgcacccgcaccgcc

SEQ ID NO: 31883 - DNA, 24 bp, Homo sapiens
caatcttcccacctcagcctccga

SEQ ID NO: 31884 - DNA, 23 bp, Homo sapiens
gaggctcagtgttggcaggtaac

SEQ ID NO: 31885 - DNA, 24 bp, Homo sapiens
gatcttgaaactagcaggtggcag

SEQ ID NO: 31886 - DNA, 23 bp, Homo sapiens
gcaatcttcccacctcagcctcc

SEQ ID NO: 31887 - DNA, 24 bp, Homo sapiens
cccaaactggccttgatcttctgg

SEQ ID NO: 31888 - DNA, 24 bp, Homo sapiens
ggttcatctgtctccatgtgctca

SEQ ID NO: 31889 - DNA, 23 bp, Homo sapiens
gaggctcagtgttggcaggtaac

SEQ ID NO: 31890 - DNA, 24 bp, Homo sapiens
caatcttcccacctcagcctccga

SEQ ID NO: 31891 - DNA, 25 bp, Homo sapiens
ttgctgtaccgtgatgtgatgctgg

SEQ ID NO: 31892 - DNA, 24 bp, Homo sapiens
gtaggagtgtcacaggtcatggct

SEQ ID NO: 31893 - DNA, 25 bp, Homo sapiens
ttctgaaggacattctgcgtctggc

SEQ ID NO: 31894 - DNA, 23 bp, Homo sapiens
ttgacagatggcaagactgaggc

SEQ ID NO: 31895 - DNA, 25 bp, Homo sapiens
ggcaagatggagtctcgttctgtcg

SEQ ID NO: 31896 - DNA, 23 bp, Homo sapiens
ctggagtgcggtggcgtgatctc

SEQ ID NO: 31897 - DNA, 24 bp, Homo sapiens
gcccgccacctcccctgccccgag

SEQ ID NO: 31898 - DNA, 24 bp, Homo sapiens
cgcccgccacctcccctgccccga

SEQ ID NO: 31899 - DNA, 24 bp, Homo sapiens
ccgcccgccacctcccctgccccg

SEQ ID NO: 31900 - DNA, 24 bp, Homo sapiens
ttactttggatatttgctgaaagg

SEQ ID NO: 31901 - DNA, 24 bp, Homo sapiens
gttactttggatatttgctgaaag

SEQ ID NO: 31902 - DNA, 24 bp, Homo sapiens
tgttactttggatatttgctgaaa

SEQ ID NO: 31903 - DNA, 25 bp, Homo sapiens
agttccaaggaggactgggtgttcc

SEQ ID NO: 31904 - DNA, 23 bp, Homo sapiens
ctgctgctcctgctgctgtcact

SEQ ID NO: 31905 - DNA, 23 bp, Homo sapiens
tttgtttcctctcggattacggc

SEQ ID NO: 31906 - DNA, 24 bp, Homo sapiens
aaggttcttggactctgcgtgctg

SEQ ID NO: 31907 - DNA, 24 bp, Homo sapiens
gctcaagcgatcctcccacctcag

SEQ ID NO: 31908 - DNA, 24 bp, Homo sapiens
actaaccacaggtctctgggtcct

SEQ ID NO: 31909 - DNA, 23 bp, Homo sapiens
agactcgcagcagccacatccta

SEQ ID NO: 31910 - DNA, 25 bp, Homo sapiens
acttgacataccaccagtacatgcc

SEQ ID NO: 31911 - DNA, 25 bp, Homo sapiens
ccgagccagaatattgtcctccttg

SEQ ID NO: 31912 - DNA, 23 bp, Homo sapiens
aactggcatcaggcttcggaagg

SEQ ID NO: 31913 - DNA, 25 bp, Homo sapiens
ggaacaatacggagaccttggtgtc

SEQ ID NO: 31914 - DNA, 24 bp, Homo sapiens
ccagcccagccacgatcatcaatt

SEQ ID NO: 31915 - DNA, 23 bp, Homo sapiens
gctggtggctatgtctcctcctt

SEQ ID NO: 31916 - DNA, 23 bp, Homo sapiens
ggagtcgcacctgtcggaccagc

SEQ ID NO: 31917 - DNA, 24 bp, Homo sapiens
gacgtggacctggagctgttcaac

SEQ ID NO: 31918 - DNA, 24 bp, Homo sapiens
actgggctcaggatgaaaggcttc

SEQ ID NO: 31919 - DNA, 24 bp, Homo sapiens
tactgggctcaggatgaaaggctt

SEQ ID NO: 31920 - DNA, 24 bp, Homo sapiens
ttactgggctcaggatgaaaggct

SEQ ID NO: 31921 - DNA, 24 bp, Homo sapiens
ttgggaggctaagggtctcactct

SEQ ID NO: 31922 - DNA, 24 bp, Homo sapiens
gcagtggctcacgcctgtaattcc

SEQ ID NO: 31923 - DNA, 24 bp, Homo sapiens
ctggaagggcggggatgagggatg

SEQ ID NO: 31924 - DNA, 24 bp, Homo sapiens
gtggcacccaggagactgtctggc

SEQ ID NO: 31925 - DNA, 24 bp, Homo sapiens
ggtggcacccaggagactgtctgg

SEQ ID NO: 31926 - DNA, 24 bp, Homo sapiens
aggtggcacccaggagactgtctg

SEQ ID NO: 31927 - DNA, 24 bp, Homo sapiens
cagaagaagtgctacaagggctcc

SEQ ID NO: 31928 - DNA, 25 bp, Homo sapiens
accagcatgaagttcacctatgact

SEQ ID NO: 31929 - DNA, 24 bp, Homo sapiens
gcagcagcagcacacaaatgacaa

SEQ ID NO: 31930 - DNA, 24 bp, Homo sapiens
tcggcttcctgttcatcgtctatt

SEQ ID NO: 31931 - DNA, 24 bp, Homo sapiens
ccaaccgcctctggtgttccaagg

SEQ ID NO: 31932 - DNA, 24 bp, Homo sapiens
agccgtggctggtgggcctggctg

SEQ ID NO: 31933 - DNA, 23 bp, Homo sapiens
caggacatgggtgttactgtgcc

SEQ ID NO: 31934 - DNA, 23 bp, Homo sapiens
aaaataacccacgcagggactct

SEQ ID NO: 31935 - DNA, 23 bp, Homo sapiens
tgagtcactgcgcctggcccaag

SEQ ID NO: 31936 - DNA, 24 bp, Homo sapiens
tcttcatccgtccacctcagcctc

SEQ ID NO: 31937 - DNA, 23 bp, Homo sapiens
gaggcagcacagaggcaggaaac

SEQ ID NO: 31938 - DNA, 24 bp, Homo sapiens
ggactctcagcccacaagtgaagc

SEQ ID NO: 31939 - DNA, 23 bp, Homo sapiens
ggagaatcgcctgaacctgggag

SEQ ID NO: 31940 - DNA, 25 bp, Homo sapiens
tccaagacgaacttcaccaacctgc

SEQ ID NO: 31941 - DNA, 23 bp, Homo sapiens
tacagagcatggtccaggagggc

SEQ ID NO: 31942 - DNA, 23 bp, Homo sapiens
gcagaggaagccacgcaccaact

SEQ ID NO: 31943 - DNA, 23 bp, Homo sapiens
gctgaggctggcgtttgaggaag

SEQ ID NO: 31944 - DNA, 23 bp, Homo sapiens
gccagcagatgatccaactcctg

SEQ ID NO: 31945 - DNA, 23 bp, Homo sapiens
ctggaggtagcggcggcggcgac

SEQ ID NO: 31946 - DNA, 23 bp, Homo sapiens
gcccaagcgtcagcggcccgcgc

SEQ ID NO: 31947 - DNA, 23 bp, Homo sapiens
aggccggtgagggggcgcggggg

SEQ ID NO: 31948 - DNA, 24 bp, Homo sapiens
cctatgaacagaaattccatcttc

SEQ ID NO: 31949 - DNA, 24 bp, Homo sapiens
ccctatgaacagaaattccatctt

SEQ ID NO: 31950 - DNA, 24 bp, Homo sapiens
tccctatgaacagaaattccatct

SEQ ID NO: 31951 - DNA, 24 bp, Homo sapiens
aggaggagtggaggttgttgagcc

SEQ ID NO: 31952 - DNA, 24 bp, Homo sapiens
agggaggtgatgctggagacttat

SEQ ID NO: 31953 - DNA, 23 bp, Homo sapiens
gacctctgtccagaatcgaagcc

SEQ ID NO: 31954 - DNA, 24 bp, Homo sapiens
ctggacttggtgctgggctctgtg

SEQ ID NO: 31955 - DNA, 24 bp, Homo sapiens
ggaagatgggcagcagaagaaggc

SEQ ID NO: 31956 - DNA, 24 bp, Homo sapiens
gcccagcatcaagcctttcaggat

SEQ ID NO: 31957 - DNA, 24 bp, Homo sapiens
ttcacatttagggcttttgaagat

SEQ ID NO: 31958 - DNA, 24 bp, Homo sapiens
tttcacatttagggcttttgaaga

SEQ ID NO: 31959 - DNA, 24 bp, Homo sapiens
ttttcacatttagggcttttgaag

SEQ ID NO: 31960 - DNA, 24 bp, Homo sapiens
gaccaggacagaacaggaagcaca

SEQ ID NO: 31961 - DNA, 24 bp, Homo sapiens
gttcacgccattctcctgcctcag

SEQ ID NO: 31962 - DNA, 24 bp, Homo sapiens
gccactggtaacttgccgtctact

SEQ ID NO: 31963 - DNA, 24 bp, Homo sapiens
ccaagaatcgggtcagtttcgcat

SEQ ID NO: 31964 - DNA, 24 bp, Homo sapiens
accaagaatcgggtcagtttcgca

SEQ ID NO: 31965 - DNA, 24 bp, Homo sapiens
caccaagaatcgggtcagtttcgc

SEQ ID NO: 31966 - DNA, 24 bp, Homo sapiens
tgttttaaaacgcctccctccact

SEQ ID NO: 31967 - DNA, 24 bp, Homo sapiens
atgttttaaaacgcctccctccac

SEQ ID NO: 31968 - DNA, 24 bp, Homo sapiens
catgttttaaaacgcctccctcca

SEQ ID NO: 31969 - DNA, 24 bp, Homo sapiens
aaactcagcaggtatccttttagt

SEQ ID NO: 31970 - DNA, 24 bp, Homo sapiens
aaaactcagcaggtatccttttag

SEQ ID NO: 31971 - DNA, 24 bp, Homo sapiens
aaaaactcagcaggtatcctttta

SEQ ID NO: 31972 - DNA, 24 bp, Homo sapiens
atgcctgaaatcccagcactttgg

SEQ ID NO: 31973 - DNA, 23 bp, Homo sapiens
aggatagaagtgaaggaggccgg

SEQ ID NO: 31974 - DNA, 24 bp, Homo sapiens
gcttcctgagttcctgagaccgtg

SEQ ID NO: 31975 - DNA, 24 bp, Homo sapiens
gcttgtcaactccgcatctgctgg

SEQ ID NO: 31976 - DNA, 24 bp, Homo sapiens
aatgatcctcctgcctcagcctcc

SEQ ID NO: 31977 - DNA, 25 bp, Homo sapiens
gaatccatgatgtcatctgccacca

SEQ ID NO: 31978 - DNA, 25 bp, Homo sapiens
ggctcctcattactgttccttctat

SEQ ID NO: 31979 - DNA, 25 bp, Homo sapiens
tctaactcccaggctcaagtgatcc

SEQ ID NO: 31980 - DNA, 24 bp, Homo sapiens
tgggattacaggcgtgagccaccg

SEQ ID NO: 31981 - DNA, 24 bp, Homo sapiens
ctgggattacaggcgtgagccacc

SEQ ID NO: 31982 - DNA, 24 bp, Homo sapiens
gctgggattacaggcgtgagccac

SEQ ID NO: 31983 - DNA, 24 bp, Homo sapiens
cgaggtcacactgctggtactcag

SEQ ID NO: 31984 - DNA, 23 bp, Homo sapiens
cactgaaacctctgcctcctggg

SEQ ID NO: 31985 - DNA, 23 bp, Homo sapiens
accgagtcttgctctgtcaccca

SEQ ID NO: 31986 - DNA, 24 bp, Homo sapiens
ttgtattttttttttttgagagtc

SEQ ID NO: 31987 - DNA, 24 bp, Homo sapiens
attgtattttttttttttgagagt

SEQ ID NO: 31988 - DNA, 24 bp, Homo sapiens
attgtattttttttttttgagagt

SEQ ID NO: 31989 - DNA, 24 bp, Homo sapiens
cggtctacgtcaaggtcaagagcg

SEQ ID NO: 31990 - DNA, 23 bp, Homo sapiens
caccgccgccgccgcctgcgaag

SEQ ID NO: 31991 - DNA, 23 bp, Homo sapiens
ctgactgcgccgaggggccggtg

SEQ ID NO: 31992 - DNA, 23 bp, Homo sapiens
gctgagtggctgttgggctgaaa

SEQ ID NO: 31993 - DNA, 25 bp, Homo sapiens
cgttactcttcaaggtataagccat

SEQ ID NO: 31994 - DNA, 25 bp, Homo sapiens
tgttggtcagatactcaatatggct

SEQ ID NO: 31995 - DNA, 24 bp, Homo sapiens
tgggattacaggcatgagccacct

SEQ ID NO: 31996 - DNA, 24 bp, Homo sapiens
ctgggattacaggcatgagccacc

SEQ ID NO: 31997 - DNA, 24 bp, Homo sapiens
gctgggattacaggcatgagccac

SEQ ID NO: 31998 - DNA, 24 bp, Homo sapiens
cccagaaaacgaatcctgcggtgt

SEQ ID NO: 31999 - DNA, 24 bp, Homo sapiens
aggtgggagcagggtcgtggcgtc

SEQ ID NO: 32000 - DNA, 24 bp, Homo sapiens
tccgggctgcagggggcgcggagc

SEQ ID NO: 32001 - DNA, 24 bp, Homo sapiens
cactcactgtgccttggttacggg

SEQ ID NO: 32002 - DNA, 24 bp, Homo sapiens
cccaccagcccctgatcccaaaga

SEQ ID NO: 32003 - DNA, 24 bp, Homo sapiens
gctgagcgtcggtcatgaaatatt

SEQ ID NO: 32004 - DNA, 24 bp, Homo sapiens
caggaagcctaacttgcgaactgc

SEQ ID NO: 32005 - DNA, 25 bp, Homo sapiens
ctgctggcaccttgatcttggactt

SEQ ID NO: 32006 - DNA, 24 bp, Homo sapiens
catctcctcctgaagacacagtgc

SEQ ID NO: 32007 - DNA, 25 bp, Homo sapiens
gtggtgggattctcggctctgattg

SEQ ID NO: 32008 - DNA, 23 bp, Homo sapiens
ccttttggccgcgttgtctcctg

SEQ ID NO: 32009 - DNA, 24 bp, Homo sapiens
gtggattcacttagctctcctccc

SEQ ID NO: 32010 - DNA, 25 bp, Homo sapiens
atgctgatgactacttcctcctgcg

SEQ ID NO: 32011 - DNA, 23 bp, Homo sapiens
gagaacctccaggacctgctgcc

SEQ ID NO: 32012 - DNA, 23 bp, Homo sapiens
aaccaggcggcagcggatacaag

SEQ ID NO: 32013 - DNA, 23 bp, Homo sapiens
acctgctgcccatactgcccaat

SEQ ID NO: 32014 - DNA, 23 bp, Homo sapiens
aaccaggcggcagcggatacaag

SEQ ID NO: 32015 - DNA, 23 bp, Homo sapiens
ctgagcccccagcagcaggaagc

SEQ ID NO: 32016 - DNA, 24 bp, Homo sapiens
gcttacgggcgaagacttgcttgt

SEQ ID NO: 32017 - DNA, 24 bp, Homo sapiens
actcctggactcaagcgatcctcc

SEQ ID NO: 32018 - DNA, 23 bp, Homo sapiens
agatagggtctcactctgtcgcc

SEQ ID NO: 32019 - DNA, 23 bp, Homo sapiens
ctcttggtcgagtgcagtggctc

SEQ ID NO: 32020 - DNA, 23 bp, Homo sapiens
gcggtatctgaccatcgtcggcg

SEQ ID NO: 32021 - DNA, 23 bp, Homo sapiens
ccttcctccatcgcctagagcaa

SEQ ID NO: 32022 - DNA, 24 bp, Homo sapiens
gcaactgaagccaacaagacacgg

SEQ ID NO: 32023 - DNA, 24 bp, Homo sapiens
ggttcaagcgattctcctgcctca

SEQ ID NO: 32024 - DNA, 24 bp, Homo sapiens
caagcagcaacggtagcagtggtg

SEQ ID NO: 32025 - DNA, 24 bp, Homo sapiens
ttttgtaccaggcacatggatggg

SEQ ID NO: 32026 - DNA, 24 bp, Homo sapiens
tttttgtaccaggcacatggatgg

SEQ ID NO: 32027 - DNA, 24 bp, Homo sapiens
atttttgtaccaggcacatggatg

SEQ ID NO: 32028 - DNA, 25 bp, Homo sapiens
acaacaccagagactgcaccattcc

SEQ ID NO: 32029 - DNA, 25 bp, Homo sapiens
cagtgtgcatggaggataagtgagc

SEQ ID NO: 32030 - DNA, 23 bp, Homo sapiens
tacaggagcagcacaccaggagc

SEQ ID NO: 32031 - DNA, 23 bp, Homo sapiens
ctggggctgctgctggtgctggg

SEQ ID NO: 32032 - DNA, 23 bp, Homo sapiens
cgatgcgcggacccgggcacccc

SEQ ID NO: 32033 - DNA, 25 bp, Homo sapiens
tggaagagtattcagcacggactgg

SEQ ID NO: 32034 - DNA, 24 bp, Homo sapiens
ctcaagagatcctcctgccttggc

SEQ ID NO: 32035 - DNA, 25 bp, Homo sapiens
tctgtgttctgtagagatggggtct

SEQ ID NO: 32036 - DNA, 24 bp, Homo sapiens
aaaaactgaaggtaatttcttctt

SEQ ID NO: 32037 - DNA, 24 bp, Homo sapiens
gaaaaactgaaggtaatttcttct

SEQ ID NO: 32038 - DNA, 24 bp, Homo sapiens
agaaaaactgaaggtaatttcttc

SEQ ID NO: 32039 - DNA, 24 bp, Homo sapiens
agataaatgaggctttgaaaagga

SEQ ID NO: 32040 - DNA, 24 bp, Homo sapiens
gagataaatgaggctttgaaaagg

SEQ ID NO: 32041 - DNA, 24 bp, Homo sapiens
cgagataaatgaggctttgaaaag

SEQ ID NO: 32042 - DNA, 24 bp, Homo sapiens
taaaagcaaaggaatggaattctg

SEQ ID NO: 32043 - DNA, 24 bp, Homo sapiens
ataaaagcaaaggaatggaattct

SEQ ID NO: 32044 - DNA, 24 bp, Homo sapiens
aataaaagcaaaggaatggaattc

SEQ ID NO: 32045 - DNA, 24 bp, Homo sapiens
attttattcccgtaagtataatgt

SEQ ID NO: 32046 - DNA, 24 bp, Homo sapiens
tattttattcccgtaagtataatg

SEQ ID NO: 32047 - DNA, 24 bp, Homo sapiens
ctattttattcccgtaagtataat

SEQ ID NO: 32048 - DNA, 24 bp, Homo sapiens
acaaaaaagaggtagcaattgtgg

SEQ ID NO: 32049 - DNA, 24 bp, Homo sapiens
gacaaaaaagaggtagcaattgtg

SEQ ID NO: 32050 - DNA, 24 bp, Homo sapiens
agacaaaaaagaggtagcaattgt

SEQ ID NO: 32051 - DNA, 25 bp, Homo sapiens
gctgtctgattcctgatcctgtccg

SEQ ID NO: 32052 - DNA, 23 bp, Homo sapiens
tactcgggaggctgaggcaggaa

SEQ ID NO: 32053 - DNA, 23 bp, Homo sapiens
gtctttcaaacccagcagtgagc

SEQ ID NO: 32054 - DNA, 25 bp, Homo sapiens
gctgtctgattcctgatcctgtccg

SEQ ID NO: 32055 - DNA, 23 bp, Homo sapiens
tactcgggaggctgaggcaggaa

SEQ ID NO: 32056 - DNA, 23 bp, Homo sapiens
aaacgacctgcccagaccctcag

SEQ ID NO: 32057 - DNA, 24 bp, Homo sapiens
atttaaagaaagtaagtaaaaagg

SEQ ID NO: 32058 - DNA, 24 bp, Homo sapiens
tatttaaagaaagtaagtaaaaag

SEQ ID NO: 32059 - DNA, 24 bp, Homo sapiens
atatttaaagaaagtaagtaaaaa

SEQ ID NO: 32060 - DNA, 24 bp, Homo sapiens
acaaagaaagtcaagcagccagtg

SEQ ID NO: 32061 - DNA, 24 bp, Homo sapiens
cgtggctgggtgtggaaccaattt

SEQ ID NO: 32062 - DNA, 24 bp, Homo sapiens
aagagtcaacgcaatgaactgtta

SEQ ID NO: 32063 - DNA, 24 bp, Homo sapiens
aatacgtagaggcttttttcctca

SEQ ID NO: 32064 - DNA, 24 bp, Homo sapiens
caatacgtagaggcttttttcctc

SEQ ID NO: 32065 - DNA, 24 bp, Homo sapiens
tcaatacgtagaggcttttttcct

SEQ ID NO: 32066 - DNA, 25 bp, Homo sapiens
tggagtacagtggcatgatcgtagc

SEQ ID NO: 32067 - DNA, 24 bp, Homo sapiens
gctcaggagatccatctcagcctc

SEQ ID NO: 32068 - DNA, 23 bp, Homo sapiens
gggctcaagtgatcctcccacct

SEQ ID NO: 32069 - DNA, 23 bp, Homo sapiens
cctgggtagctacaactgcatat

SEQ ID NO: 32070 - DNA, 23 bp, Homo sapiens
cgtagctcattgcagcctccacc

SEQ ID NO: 32071 - DNA, 24 bp, Homo sapiens
gctcaggagatccatctcagcctc

SEQ ID NO: 32072 - DNA, 23 bp, Homo sapiens
ttcattacaacctccgcctcccg

SEQ ID NO: 32073 - DNA, 24 bp, Homo sapiens
ggctggagtacagtggcatgatcg

SEQ ID NO: 32074 - DNA, 25 bp, Homo sapiens
gctgggattatagagggtcttactt

SEQ ID NO: 32075 - DNA, 24 bp, Homo sapiens
tcttaatacaggtaaaattaagac

SEQ ID NO: 32076 - DNA, 24 bp, Homo sapiens
atcttaatacaggtaaaattaaga

SEQ ID NO: 32077 - DNA, 24 bp, Homo sapiens
gatcttaatacaggtaaaattaag

SEQ ID NO: 32078 - DNA, 24 bp, Homo sapiens
tattatgccatgtataatggacag

SEQ ID NO: 32079 - DNA, 24 bp, Homo sapiens
ttattatgccatgtataatggaca

SEQ ID NO: 32080 - DNA, 24 bp, Homo sapiens
tttattatgccatgtataatggac

SEQ ID NO: 32081 - DNA, 24 bp, Homo sapiens
ggtgtccttgttttgtatcttagc

SEQ ID NO: 32082 - DNA, 24 bp, Homo sapiens
tggtgtccttgttttgtatcttag

SEQ ID NO: 32083 - DNA, 24 bp, Homo sapiens
gtggtgtccttgttttgtatctta

SEQ ID NO: 32084 - DNA, 24 bp, Homo sapiens
tgaaaagtaaaataaagaaatggg

SEQ ID NO: 32085 - DNA, 24 bp, Homo sapiens
ttgaaaagtaaaataaagaaatgg

SEQ ID NO: 32086 - DNA, 24 bp, Homo sapiens
tttgaaaagtaaaataaagaaatg

SEQ ID NO: 32087 - DNA, 24 bp, Homo sapiens
ttggagcctttctagcaatttttg

SEQ ID NO: 32088 - DNA, 24 bp, Homo sapiens
cttggagcctttctagcaattttt

SEQ ID NO: 32089 - DNA, 24 bp, Homo sapiens
acttggagcctttctagcaatttt

SEQ ID NO: 32090 - DNA, 24 bp, Homo sapiens
gtctaaagaaggtaaatatatagt

SEQ ID NO: 32091 - DNA, 24 bp, Homo sapiens
agtctaaagaaggtaaatatatag

SEQ ID NO: 32092 - DNA, 24 bp, Homo sapiens
tagtctaaagaaggtaaatatata

SEQ ID NO: 32093 - DNA, 24 bp, Homo sapiens
tataccactctgttaattatgtat

SEQ ID NO: 32094 - DNA, 24 bp, Homo sapiens
atataccactctgttaattatgta

SEQ ID NO: 32095 - DNA, 24 bp, Homo sapiens
aatataccactctgttaattatgt

SEQ ID NO: 32096 - DNA, 25 bp, Homo sapiens
caaattaagggtctcgctctgtcac

SEQ ID NO: 32097 - DNA, 25 bp, Homo sapiens
ggtttatatcagtcaaggtcccagg

SEQ ID NO: 32098 - DNA, 25 bp, Homo sapiens
tgggtgaaatcaagacagagaaaca

SEQ ID NO: 32099 - DNA, 25 bp, Homo sapiens
cagtgacctttgaggatgtggctgt

SEQ ID NO: 32100 - DNA, 24 bp, Homo sapiens
ccgctcttgaggatcttgcttgtc

SEQ ID NO: 32101 - DNA, 25 bp, Homo sapiens
ctgccctaaagaacttgccctgaca

SEQ ID NO: 32102 - DNA, 24 bp, Homo sapiens
acttttaaaagatcatcaggatac

SEQ ID NO: 32103 - DNA, 24 bp, Homo sapiens
cacttttaaaagatcatcaggata

SEQ ID NO: 32104 - DNA, 24 bp, Homo sapiens
gcacttttaaaagatcatcaggat

SEQ ID NO: 32105 - DNA, 25 bp, Homo sapiens
gtggacgattacgccgaataactga

SEQ ID NO: 32106 - DNA, 25 bp, Homo sapiens
cacagaacatcagcactggaatggc

SEQ ID NO: 32107 - DNA, 23 bp, Homo sapiens
atcctcccacttcagcctcccga

SEQ ID NO: 32108 - DNA, 24 bp, Homo sapiens
ttgctcctccttgccttctgccat

SEQ ID NO: 32109 - DNA, 24 bp, Homo sapiens
gctattcctgtctacacgccctct

SEQ ID NO: 32110 - DNA, 24 bp, Homo sapiens
gcagatgggatctcaaagccaagt

SEQ ID NO: 32111 - DNA, 24 bp, Homo sapiens
ttccgttctacagtgtgaccatct

SEQ ID NO: 32112 - DNA, 24 bp, Homo sapiens
attgcctggttctccactgacagc

SEQ ID NO: 32113 - DNA, 24 bp, Homo sapiens
aacagcaaacagtagcagcagcat

SEQ ID NO: 32114 - DNA, 24 bp, Homo sapiens
gctattcctgtctacacgccctct

SEQ ID NO: 32115 - DNA, 24 bp, Homo sapiens
gcagatgggatctcaaagccaagt

SEQ ID NO: 32116 - DNA, 24 bp, Homo sapiens
gacttgctcctccttgccttctgc

SEQ ID NO: 32117 - DNA, 24 bp, Homo sapiens
tttctgtgaagttataaagaataa

SEQ ID NO: 32118 - DNA, 24 bp, Homo sapiens
atttctgtgaagttataaagaata

SEQ ID NO: 32119 - DNA, 24 bp, Homo sapiens
aatttctgtgaagttataaagaat

SEQ ID NO: 32120 - DNA, 24 bp, Homo sapiens
catcttcacagatacttttaattt

SEQ ID NO: 32121 - DNA, 24 bp, Homo sapiens
acatcttcacagatacttttaatt

SEQ ID NO: 32122 - DNA, 24 bp, Homo sapiens
tacatcttcacagatacttttaat

SEQ ID NO: 32123 - DNA, 24 bp, Homo sapiens
cttttatatttattctggactttt

SEQ ID NO: 32124 - DNA, 24 bp, Homo sapiens
tcttttatatttattctggacttt

SEQ ID NO: 32125 - DNA, 24 bp, Homo sapiens
atcttttatatttattctggactt

SEQ ID NO: 32126 - DNA, 25 bp, Homo sapiens
agtagagccaagagttgagggtccg

SEQ ID NO: 32127 - DNA, 24 bp, Homo sapiens
caatctcaggttggacaatcgtga

SEQ ID NO: 32128 - DNA, 23 bp, Homo sapiens
gtttcaccgtgttagccaggatg

SEQ ID NO: 32129 - DNA, 24 bp, Homo sapiens
cctgcagccagcccaccgccagct

SEQ ID NO: 32130 - DNA, 24 bp, Homo sapiens
ccctgcagccagcccaccgccagc

SEQ ID NO: 32131 - DNA, 24 bp, Homo sapiens
gccctgcagccagcccaccgccag

SEQ ID NO: 32132 - DNA, 23 bp, Homo sapiens
aggaccctgcccgatgcccacat

SEQ ID NO: 32133 - DNA, 23 bp, Homo sapiens
cgcctccagtgataccatcgagc

SEQ ID NO: 32134 - DNA, 23 bp, Homo sapiens
cagcacggtacagctactgcctg

SEQ ID NO: 32135 - DNA, 23 bp, Homo sapiens
ttctgctgttgctgctgccactc

SEQ ID NO: 32136 - DNA, 24 bp, Homo sapiens
cacaggaactctgatgtccgccac

SEQ ID NO: 32137 - DNA, 24 bp, Homo sapiens
agatgcctgagaagcctgtagcct

SEQ ID NO: 32138 - DNA, 24 bp, Homo sapiens
ttgaaggcggtgaagtgatggtcg

SEQ ID NO: 32139 - DNA, 24 bp, Homo sapiens
tcggtagccagtccttcacagaga

SEQ ID NO: 32140 - DNA, 24 bp, Homo sapiens
ggtcaagcgattctcctgcctcag

SEQ ID NO: 32141 - DNA, 24 bp, Homo sapiens
aaatttgcaagtatgcagagacta

SEQ ID NO: 32142 - DNA, 24 bp, Homo sapiens
gaaatttgcaagtatgcagagact

SEQ ID NO: 32143 - DNA, 24 bp, Homo sapiens
tgaaatttgcaagtatgcagagac

SEQ ID NO: 32144 - DNA, 24 bp, Homo sapiens
aaaagcaaaatgtgagtatctgtg

SEQ ID NO: 32145 - DNA, 24 bp, Homo sapiens
aaaaagcaaaatgtgagtatctgt

SEQ ID NO: 32146 - DNA, 24 bp, Homo sapiens
gaaaaagcaaaatgtgagtatctg

SEQ ID NO: 32147 - DNA, 24 bp, Homo sapiens
aaaagcaaaataataaagttcaag

SEQ ID NO: 32148 - DNA, 24 bp, Homo sapiens
aaaaagcaaaataataaagttcaa

SEQ ID NO: 32149 - DNA, 24 bp, Homo sapiens
gaaaaagcaaaataataaagttca

SEQ ID NO: 32150 - DNA, 24 bp, Homo sapiens
acattgaaaaggagataaaaacat

SEQ ID NO: 32151 - DNA, 24 bp, Homo sapiens
cacattgaaaaggagataaaaaca

SEQ ID NO: 32152 - DNA, 24 bp, Homo sapiens
ccacattgaaaaggagataaaaac

SEQ ID NO: 32153 - DNA, 25 bp, Homo sapiens
ccctgaaagatgaccgaggaggtgg

SEQ ID NO: 32154 - DNA, 23 bp, Homo sapiens
gcatcgctctgccagtgacgctg

SEQ ID NO: 32155 - DNA, 23 bp, Homo sapiens
ctcagggcagcacccacacactg

SEQ ID NO: 32156 - DNA, 24 bp, Homo sapiens
gttatctacaggtcaaaacagtca

SEQ ID NO: 32157 - DNA, 24 bp, Homo sapiens
tgttatctacaggtcaaaacagtc

SEQ ID NO: 32158 - DNA, 24 bp, Homo sapiens
ctgttatctacaggtcaaaacagt

SEQ ID NO: 32159 - DNA, 24 bp, Homo sapiens
atgatggagtctcactgtcacgca

SEQ ID NO: 32160 - DNA, 24 bp, Homo sapiens
gatcctggctcactgcaacctctg

SEQ ID NO: 32161 - DNA, 24 bp, Homo sapiens
tgggatatggagactggaagatgc

SEQ ID NO: 32162 - DNA, 24 bp, Homo sapiens
agtcacaagcctgctcaaattcgg

SEQ ID NO: 32163 - DNA, 24 bp, Homo sapiens
gggacggaaatggaacctcttcat

SEQ ID NO: 32164 - DNA, 24 bp, Homo sapiens
ccaagccatcctcctacctcagca

SEQ ID NO: 32165 - DNA, 24 bp, Homo sapiens
gggacggaaatggaacctcttcat

SEQ ID NO: 32166 - DNA, 24 bp, Homo sapiens
ccaagccatcctcctacctcagca

SEQ ID NO: 32167 - DNA, 24 bp, Homo sapiens
gcgaatgccaccacacctggaatt

SEQ ID NO: 32168 - DNA, 24 bp, Homo sapiens
cctggctggagtgcaatggtatga

SEQ ID NO: 32169 - DNA, 24 bp, Homo sapiens
ccaagccatcctcctacctcagca

SEQ ID NO: 32170 - DNA, 24 bp, Homo sapiens
gcgaatgccaccacacctggaatt

SEQ ID NO: 32171 - DNA, 24 bp, Homo sapiens
gccatcctcctacctcagcaacca

SEQ ID NO: 32172 - DNA, 24 bp, Homo sapiens
ctcacagtagccttgaactcctgg

SEQ ID NO: 32173 - DNA, 24 bp, Homo sapiens
cctggctggagtgcaatggtatga

SEQ ID NO: 32174 - DNA, 24 bp, Homo sapiens
ttctaattaaagtatgtcaagatg

SEQ ID NO: 32175 - DNA, 24 bp, Homo sapiens
tttctaattaaagtatgtcaagat

SEQ ID NO: 32176 - DNA, 24 bp, Homo sapiens
atttctaattaaagtatgtcaaga

SEQ ID NO: 32177 - DNA, 24 bp, Homo sapiens
ttccacctcagcctcccaagtagc

SEQ ID NO: 32178 - DNA, 24 bp, Homo sapiens
ttccagagcctacagaatgtgtct

SEQ ID NO: 32179 - DNA, 24 bp, Homo sapiens
gccagattcaagcattaagcactg

SEQ ID NO: 32180 - DNA, 24 bp, Homo sapiens
ggctgaggcatgaaatgaccagtg

SEQ ID NO: 32181 - DNA, 24 bp, Homo sapiens
aggctgaggcatgaaatgaccagt

SEQ ID NO: 32182 - DNA, 24 bp, Homo sapiens
aaggctgaggcatgaaatgaccag

SEQ ID NO: 32183 - DNA, 24 bp, Homo sapiens
gggattacaggcgtgagccactgt

SEQ ID NO: 32184 - DNA, 24 bp, Homo sapiens
tgggattacaggcgtgagccactg

SEQ ID NO: 32185 - DNA, 24 bp, Homo sapiens
ctgggattacaggcgtgagccact

SEQ ID NO: 32186 - DNA, 24 bp, Homo sapiens
aaccgctgctgctgctgcttctgc

SEQ ID NO: 32187 - DNA, 24 bp, Homo sapiens
gacactatgttgagtctacaggat

SEQ ID NO: 32188 - DNA, 24 bp, Homo sapiens
ttgaaattagcataaagtccttgt

SEQ ID NO: 32189 - DNA, 24 bp, Homo sapiens
gatatagtccagtaagtaaaaaaa

SEQ ID NO: 32190 - DNA, 24 bp, Homo sapiens
tgatatagtccagtaagtaaaaaa

SEQ ID NO: 32191 - DNA, 24 bp, Homo sapiens
atgatatagtccagtaagtaaaaa

SEQ ID NO: 32192 - DNA, 24 bp, Homo sapiens
aacctcaatttgaaaaagacatca

SEQ ID NO: 32193 - DNA, 24 bp, Homo sapiens
aaacctcaatttgaaaaagacatc

SEQ ID NO: 32194 - DNA, 24 bp, Homo sapiens
caaacctcaatttgaaaaagacat

SEQ ID NO: 32195 - DNA, 24 bp, Homo sapiens
tacagatgctgcttcttccgtggc

SEQ ID NO: 32196 - DNA, 24 bp, Homo sapiens
cattcagactcctcgctgctgccg

SEQ ID NO: 32197 - DNA, 24 bp, Homo sapiens
acagaccacctccaccgcctcatc

SEQ ID NO: 32198 - DNA, 24 bp, Homo sapiens
gtgttgacgctctctgctctctcc

SEQ ID NO: 32199 - DNA, 24 bp, Homo sapiens
tacagtggacaatggcttccgtgt

SEQ ID NO: 32200 - DNA, 24 bp, Homo sapiens
acttgctgctgcggagtcatatct

SEQ ID NO: 32201 - DNA, 25 bp, Homo sapiens
gaggaagagtattacaccatcgccg

SEQ ID NO: 32202 - DNA, 23 bp, Homo sapiens
caaccatcccagacggcatcagc

SEQ ID NO: 32203 - DNA, 25 bp, Homo sapiens
aacttgagtggctggtggtacattc

SEQ ID NO: 32204 - DNA, 23 bp, Homo sapiens
ccgccgccgccaacgtccctgca

SEQ ID NO: 32205 - DNA, 23 bp, Homo sapiens
tgccacgggatcttcgcgcccct

SEQ ID NO: 32206 - DNA, 23 bp, Homo sapiens
ccgcccgcgcctggccgggggag

SEQ ID NO: 32207 - DNA, 24 bp, Homo sapiens
ttgtgagaagagcgattggtgtcc

SEQ ID NO: 32208 - DNA, 24 bp, Homo sapiens
gagatggagtcttgttctgtcacc

SEQ ID NO: 32209 - DNA, 24 bp, Homo sapiens
atcttggctcactgtaacctctgc

SEQ ID NO: 32210 - DNA, 24 bp, Homo sapiens
ctttatgtcagatggtggaagaag

SEQ ID NO: 32211 - DNA, 24 bp, Homo sapiens
gctttatgtcagatggtggaagaa

SEQ ID NO: 32212 - DNA, 24 bp, Homo sapiens
tgctttatgtcagatggtggaaga

SEQ ID NO: 32213 - DNA, 25 bp, Homo sapiens
aggaggattgcttgagttcaggagt

SEQ ID NO: 32214 - DNA, 25 bp, Homo sapiens
gcattccaagcagcaaagacttcca

SEQ ID NO: 32215 - DNA, 25 bp, Homo sapiens
ctggtgtggcagcttatgtctgtaa

SEQ ID NO: 32216 - DNA, 25 bp, Homo sapiens
aagtattcttcgttgttggaaatgt

SEQ ID NO: 32217 - DNA, 25 bp, Homo sapiens
gcaagctctggttgttttatggagt

SEQ ID NO: 32218 - DNA, 25 bp, Homo sapiens
tgataactaaaaatcatagtcaaga

SEQ ID NO: 32219 - DNA, 24 bp, Homo sapiens
acaccgaatatccgacatccacga

SEQ ID NO: 32220 - DNA, 24 bp, Homo sapiens
tctcactctgttgctcaggctgga

SEQ ID NO: 32221 - DNA, 24 bp, Homo sapiens
ccatcttggctcaccacaacctcc

SEQ ID NO: 32222 - DNA, 24 bp, Homo sapiens
ctacaaataagatcactattatct

SEQ ID NO: 32223 - DNA, 24 bp, Homo sapiens
gctacaaataagatcactattatc

SEQ ID NO: 32224 - DNA, 24 bp, Homo sapiens
tgctacaaataagatcactattat

SEQ ID NO: 32225 - DNA, 25 bp, Homo sapiens
ctcaccactcctgttcatcatagca

SEQ ID NO: 32226 - DNA, 23 bp, Homo sapiens
ggagtcagcccatcacgaggttg

SEQ ID NO: 32227 - DNA, 25 bp, Homo sapiens
ccagggcaatcaggcaagagaaaga

SEQ ID NO: 32228 - DNA, 25 bp, Homo sapiens
ctcaccactcctgttcatcatagca

SEQ ID NO: 32229 - DNA, 25 bp, Homo sapiens
ccagggcaatcaggcaagagaaaga

SEQ ID NO: 32230 - DNA, 25 bp, Homo sapiens
agcatctcaggacagttactctcat

SEQ ID NO: 32231 - DNA, 25 bp, Homo sapiens
agcagaacactcaacctgaaagcag

SEQ ID NO: 32232 - DNA, 23 bp, Homo sapiens
cagcgtggcagtggaatggtgtt

SEQ ID NO: 32233 - DNA, 25 bp, Homo sapiens
tggcaaaggaaacatgtacttctag

SEQ ID NO: 32234 - DNA, 24 bp, Homo sapiens
aaactgctgaggacaagattaaac

SEQ ID NO: 32235 - DNA, 24 bp, Homo sapiens
aaaactgctgaggacaagattaaa

SEQ ID NO: 32236 - DNA, 24 bp, Homo sapiens
gaaaactgctgaggacaagattaa

SEQ ID NO: 32237 - DNA, 23 bp, Homo sapiens
gcagaccagccacctcctgtgtt

SEQ ID NO: 32238 - DNA, 25 bp, Homo sapiens
gaagagttccatctgtatctgaggc

SEQ ID NO: 32239 - DNA, 25 bp, Homo sapiens
gctcggctctataaagaattggcat

SEQ ID NO: 32240 - DNA, 24 bp, Homo sapiens
agaaaaaaagggaactcaaaaatg

SEQ ID NO: 32241 - DNA, 24 bp, Homo sapiens
gagaaaaaaagggaactcaaaaat

SEQ ID NO: 32242 - DNA, 24 bp, Homo sapiens
ggagaaaaaaagggaactcaaaaa

SEQ ID NO: 32243 - DNA, 24 bp, Homo sapiens
tgtcttgataggaagaagaagaaa

SEQ ID NO: 32244 - DNA, 24 bp, Homo sapiens
ttgtcttgataggaagaagaagaa

SEQ ID NO: 32245 - DNA, 24 bp, Homo sapiens
tttgtcttgataggaagaagaaga

SEQ ID NO: 32246 - DNA, 24 bp, Homo sapiens
cattcggtattatattggctgtgg

SEQ ID NO: 32247 - DNA, 25 bp, Homo sapiens
ccgttctcagagggaatgctttcaa

SEQ ID NO: 32248 - DNA, 25 bp, Homo sapiens
tgaagaggaacggtgagagtaggca

SEQ ID NO: 32249 - DNA, 23 bp, Homo sapiens
gctcaagtgatccacccaccgtg

SEQ ID NO: 32250 - DNA, 23 bp, Homo sapiens
cttgtggttgccgaagttggatt

SEQ ID NO: 32251 - DNA, 25 bp, Homo sapiens
cctgtagttatagtagtgcgtctgc

SEQ ID NO: 32252 - DNA, 23 bp, Homo sapiens
gctcaagtgatccacccaccgtg

SEQ ID NO: 32253 - DNA, 25 bp, Homo sapiens
tggatttctcgcaaaccaagatggg

SEQ ID NO: 32254 - DNA, 25 bp, Homo sapiens
tgtgttgcccagactggtctcaaac

SEQ ID NO: 32255 - DNA, 25 bp, Homo sapiens
ccactaacctgcacaagatcgagcc

SEQ ID NO: 32256 - DNA, 25 bp, Homo sapiens
acagaaacaagagtcattgccaggt

SEQ ID NO: 32257 - DNA, 24 bp, Homo sapiens
gcaggaagatcacttgagccaact

SEQ ID NO: 32258 - DNA, 25 bp, Homo sapiens
gacttgacagagaatgggcaggagc

SEQ ID NO: 32259 - DNA, 23 bp, Homo sapiens
tgacaggcagaaaggcagggcag

SEQ ID NO: 32260 - DNA, 24 bp, Homo sapiens
agggtttctcgctgagggacatct

SEQ ID NO: 32261 - DNA, 24 bp, Homo sapiens
cgccatcaccatctccaccttcag

SEQ ID NO: 32262 - DNA, 23 bp, Homo sapiens
gccatcttccacgacttccgcat

SEQ ID NO: 32263 - DNA, 23 bp, Homo sapiens
acttgaggcggctgaatgctgtt

SEQ ID NO: 32264 - DNA, 24 bp, Homo sapiens
acgaactcctgtgctcaagcgatc

SEQ ID NO: 32265 - DNA, 24 bp, Homo sapiens
gccactgctttatagaccaccact

SEQ ID NO: 32266 - DNA, 24 bp, Homo sapiens
cacctggcagcttcatgtacgcaa

SEQ ID NO: 32267 - DNA, 25 bp, Homo sapiens
gcagtctcaacctctcaggctcaag

SEQ ID NO: 32268 - DNA, 24 bp, Homo sapiens
cagcctcagccaagatgtctcacc

SEQ ID NO: 32269 - DNA, 25 bp, Homo sapiens
gtgctcatcacagtctggtggaatt

SEQ ID NO: 32270 - DNA, 24 bp, Homo sapiens
ccaacaaggagcctggtcagagtc

SEQ ID NO: 32271 - DNA, 24 bp, Homo sapiens
gccaacaaggagcctggtcagagt

SEQ ID NO: 32272 - DNA, 24 bp, Homo sapiens
ggccaacaaggagcctggtcagag

SEQ ID NO: 32273 - DNA, 24 bp, Homo sapiens
atgatgaaaagattttggtgtttg

SEQ ID NO: 32274 - DNA, 24 bp, Homo sapiens
tatgatgaaaagattttggtgttt

SEQ ID NO: 32275 - DNA, 24 bp, Homo sapiens
ctatgatgaaaagattttggtgtt

SEQ ID NO: 32276 - DNA, 24 bp, Homo sapiens
caacaaaaacattttcctaaaatt

SEQ ID NO: 32277 - DNA, 24 bp, Homo sapiens
acaacaaaaacattttcctaaaat

SEQ ID NO: 32278 - DNA, 24 bp, Homo sapiens
aacaacaaaaacattttcctaaaa

SEQ ID NO: 32279 - DNA, 23 bp, Homo sapiens
atggaggaggacgacgaggactc

SEQ ID NO: 32280 - DNA, 24 bp, Homo sapiens
cgtaagcgtcggttccagttatac

SEQ ID NO: 32281 - DNA, 25 bp, Homo sapiens
gccaggaagaaccgctctcacatac

SEQ ID NO: 32282 - DNA, 24 bp, Homo sapiens
cctgtgcagggatgaggcctgcct

SEQ ID NO: 32283 - DNA, 24 bp, Homo sapiens
acctgtgcagggatgaggcctgcc

SEQ ID NO: 32284 - DNA, 24 bp, Homo sapiens
aacctgtgcagggatgaggcctgc

SEQ ID NO: 32285 - DNA, 23 bp, Homo sapiens
accacagacacccagaaggagcc

SEQ ID NO: 32286 - DNA, 23 bp, Homo sapiens
tcaagtgacggctccagtcctgc

SEQ ID NO: 32287 - DNA, 23 bp, Homo sapiens
cttcaccagcagcagcagcagca

SEQ ID NO: 32288 - DNA, 23 bp, Homo sapiens
cagccagcctccttgcctccatt

SEQ ID NO: 32289 - DNA, 25 bp, Homo sapiens
aacttgcttctgccgagatgagtct

SEQ ID NO: 32290 - DNA, 23 bp, Homo sapiens
cttcaccagcagcagcagcagca

SEQ ID NO: 32291 - DNA, 25 bp, Homo sapiens
aacttgcttctgccgagatgagtct

SEQ ID NO: 32292 - DNA, 23 bp, Homo sapiens
cttcaccagcagcagcagcagca

SEQ ID NO: 32293 - DNA, 23 bp, Homo sapiens
tcaagtgacggctccagtcctgc

SEQ ID NO: 32294 - DNA, 23 bp, Homo sapiens
ctgctcctcctcaagcccccaag

SEQ ID NO: 32295 - DNA, 23 bp, Homo sapiens
gcccctgctgaaagaccggcatg

SEQ ID NO: 32296 - DNA, 23 bp, Homo sapiens
agaggctgcggtgagtccgccag

SEQ ID NO: 32297 - DNA, 24 bp, Homo sapiens
aaagaagcaatgaggaaatgaaga

SEQ ID NO: 32298 - DNA, 24 bp, Homo sapiens
taaagaagcaatgaggaaatgaag

SEQ ID NO: 32299 - DNA, 24 bp, Homo sapiens
ctaaagaagcaatgaggaaatgaa

SEQ ID NO: 32300 - DNA, 24 bp, Homo sapiens
gcgtctgctcttcctctgttcact

SEQ ID NO: 32301 - DNA, 23 bp, Homo sapiens
gaacagtcctcctgcctcagcct

SEQ ID NO: 32302 - DNA, 24 bp, Homo sapiens
actgtgcttccgtaggctttggtg

SEQ ID NO: 32303 - DNA, 24 bp, Homo sapiens
gcaacaacatgggctgagacttga

SEQ ID NO: 32304 - DNA, 24 bp, Homo sapiens
ggcaacaacatgggctgagacttg

SEQ ID NO: 32305 - DNA, 24 bp, Homo sapiens
tggcaacaacatgggctgagactt

SEQ ID NO: 32306 - DNA, 24 bp, Homo sapiens
gggacacagacacaaccacagagg

SEQ ID NO: 32307 - DNA, 24 bp, Homo sapiens
cctaatccagtgtgattggtgtcc

SEQ ID NO: 32308 - DNA, 24 bp, Homo sapiens
gcaggtatcatggactgttcaacc

SEQ ID NO: 32309 - DNA, 24 bp, Homo sapiens
tggggatgccagtggcgtggaggc

SEQ ID NO: 32310 - DNA, 24 bp, Homo sapiens
ctggggatgccagtggcgtggagg

SEQ ID NO: 32311 - DNA, 24 bp, Homo sapiens
gctggggatgccagtggcgtggag

SEQ ID NO: 32312 - DNA, 24 bp, Homo sapiens
ccactgtgcccagccttaggagaa

SEQ ID NO: 32313 - DNA, 24 bp, Homo sapiens
agtgtcagcaagtgagcaaggagg

SEQ ID NO: 32314 - DNA, 24 bp, Homo sapiens
agaaatgggcattggcaagttggc

SEQ ID NO: 32315 - DNA, 24 bp, Homo sapiens
gaaatgaaaatgtaagacatttta

SEQ ID NO: 32316 - DNA, 24 bp, Homo sapiens
agaaatgaaaatgtaagacatttt

SEQ ID NO: 32317 - DNA, 24 bp, Homo sapiens
gagaaatgaaaatgtaagacattt

SEQ ID NO: 32318 - DNA, 24 bp, Homo sapiens
gttattaacagttgcacagacccc

SEQ ID NO: 32319 - DNA, 24 bp, Homo sapiens
cgttattaacagttgcacagaccc

SEQ ID NO: 32320 - DNA, 24 bp, Homo sapiens
tcgttattaacagttgcacagacc

SEQ ID NO: 32321 - DNA, 24 bp, Homo sapiens
ttgggtttaataaacagagatttt

SEQ ID NO: 32322 - DNA, 24 bp, Homo sapiens
tttgggtttaataaacagagattt

SEQ ID NO: 32323 - DNA, 24 bp, Homo sapiens
atttgggtttaataaacagagatt

SEQ ID NO: 32324 - DNA, 24 bp, Homo sapiens
acagccatactgattatcaactac

SEQ ID NO: 32325 - DNA, 24 bp, Homo sapiens
aacagccatactgattatcaacta

SEQ ID NO: 32326 - DNA, 24 bp, Homo sapiens
taacagccatactgattatcaact

SEQ ID NO: 32327 - DNA, 24 bp, Homo sapiens
ttctactcttggtaagtttggact

SEQ ID NO: 32328 - DNA, 24 bp, Homo sapiens
tttctactcttggtaagtttggac

SEQ ID NO: 32329 - DNA, 24 bp, Homo sapiens
atttctactcttggtaagtttgga

SEQ ID NO: 32330 - DNA, 24 bp, Homo sapiens
gaaatgcactgaatttcacaaact

SEQ ID NO: 32331 - DNA, 24 bp, Homo sapiens
ggaaatgcactgaatttcacaaac

SEQ ID NO: 32332 - DNA, 24 bp, Homo sapiens
aggaaatgcactgaatttcacaaa

SEQ ID NO: 32333 - DNA, 24 bp, Homo sapiens
aagagtgtgagcaaggcaggcaag

SEQ ID NO: 32334 - DNA, 23 bp, Homo sapiens
gccacgagttccaggagaccaag

SEQ ID NO: 32335 - DNA, 25 bp, Homo sapiens
gccaaggagatgaaggagttctacc

SEQ ID NO: 32336 - DNA, 23 bp, Homo sapiens
agctggagctgctggagaacacc

SEQ ID NO: 32337 - DNA, 23 bp, Homo sapiens
ggtctcccagcaaggcatgaagc

SEQ ID NO: 32338 - DNA, 25 bp, Homo sapiens
tcaaagagaacaacggcattaccct

SEQ ID NO: 32339 - DNA, 24 bp, Homo sapiens
caatacctggatgtatgcctcacg

SEQ ID NO: 32340 - DNA, 24 bp, Homo sapiens
tagttactgctgtgcctggcttca

SEQ ID NO: 32341 - DNA, 24 bp, Homo sapiens
ggttcaagcgattctcctgcctca

SEQ ID NO: 32342 - DNA, 24 bp, Homo sapiens
tttattattagttccacctttcca

SEQ ID NO: 32343 - DNA, 24 bp, Homo sapiens
ttttattattagttccacctttcc

SEQ ID NO: 32344 - DNA, 24 bp, Homo sapiens
tttttattattagttccacctttc

SEQ ID NO: 32345 - DNA, 23 bp, Homo sapiens
ctactgcgaaggggaggaaagcg

SEQ ID NO: 32346 - DNA, 23 bp, Homo sapiens
gatccgctgtcgccgccgctctg

SEQ ID NO: 32347 - DNA, 23 bp, Homo sapiens
ccgggccccgagccgccccgctt

SEQ ID NO: 32348 - DNA, 24 bp, Homo sapiens
tggaaaaaaagctttaaatgtcat

SEQ ID NO: 32349 - DNA, 24 bp, Homo sapiens
gtggaaaaaaagctttaaatgtca

SEQ ID NO: 32350 - DNA, 24 bp, Homo sapiens
agtggaaaaaaagctttaaatgtc

SEQ ID NO: 32351 - DNA, 24 bp, Homo sapiens
cccaggaacttcaggaaccagtcc

SEQ ID NO: 32352 - DNA, 24 bp, Homo sapiens
gcggcttctggcttctctgtggag

SEQ ID NO: 32353 - DNA, 24 bp, Homo sapiens
ggagaatgcggtggctgtaaaggg

SEQ ID NO: 32354 - DNA, 23 bp, Homo sapiens
gactctggacacaatggcggctc

SEQ ID NO: 32355 - DNA, 25 bp, Homo sapiens
cttgaagtcagcgagaccatgaacc

SEQ ID NO: 32356 - DNA, 25 bp, Homo sapiens
gtaacactcactgcgaaggtccaca

SEQ ID NO: 32357 - DNA, 25 bp, Homo sapiens
accaagtcaagcattgtcctccacg

SEQ ID NO: 32358 - DNA, 23 bp, Homo sapiens
gactctggacacaatggcggctc

SEQ ID NO: 32359 - DNA, 25 bp, Homo sapiens
cttgaagtcagcgagaccatgaacc

SEQ ID NO: 32360 - DNA, 24 bp, Homo sapiens
gctgttgaaaaatctattaatgct

SEQ ID NO: 32361 - DNA, 24 bp, Homo sapiens
tgctgttgaaaaatctattaatgc

SEQ ID NO: 32362 - DNA, 24 bp, Homo sapiens
ctgctgttgaaaaatctattaatg

SEQ ID NO: 32363 - DNA, 24 bp, Homo sapiens
aaaatggaaaggtaaaaagaacct

SEQ ID NO: 32364 - DNA, 24 bp, Homo sapiens
gaaaatggaaaggtaaaaagaacc

SEQ ID NO: 32365 - DNA, 24 bp, Homo sapiens
agaaaatggaaaggtaaaaagaac

SEQ ID NO: 32366 - DNA, 24 bp, Homo sapiens
tatttacctaggtcacagtagaca

SEQ ID NO: 32367 - DNA, 24 bp, Homo sapiens
ttatttacctaggtcacagtagac

SEQ ID NO: 32368 - DNA, 24 bp, Homo sapiens
tttatttacctaggtcacagtaga

SEQ ID NO: 32369 - DNA, 24 bp, Homo sapiens
gaagatatatggagttgctgttta

SEQ ID NO: 32370 - DNA, 24 bp, Homo sapiens
agaagatatatggagttgctgttt

SEQ ID NO: 32371 - DNA, 24 bp, Homo sapiens
gagaagatatatggagttgctgtt

SEQ ID NO: 32372 - DNA, 24 bp, Homo sapiens
aaaaaatcaagatgatgaaaccga

SEQ ID NO: 32373 - DNA, 24 bp, Homo sapiens
gaaaaaatcaagatgatgaaaccg

SEQ ID NO: 32374 - DNA, 24 bp, Homo sapiens
tgaaaaaatcaagatgatgaaacc

SEQ ID NO: 32375 - DNA, 25 bp, Homo sapiens
ggttcaagcaatcaagcaattcttc

SEQ ID NO: 32376 - DNA, 23 bp, Homo sapiens
ttatggagtcttgctctgttgcc

SEQ ID NO: 32377 - DNA, 25 bp, Homo sapiens
cactttctacatcgttacctcctgg

SEQ ID NO: 32378 - DNA, 25 bp, Homo sapiens
cctcctgccagattacttgaattgc

SEQ ID NO: 32379 - DNA, 23 bp, Homo sapiens
tacaatagtctcgctctgtcgcc

SEQ ID NO: 32380 - DNA, 25 bp, Homo sapiens
gcagtggtgtgatcttggctcattg

SEQ ID NO: 32381 - DNA, 24 bp, Homo sapiens
agaagcaaaaaaacttcattatgt

SEQ ID NO: 32382 - DNA, 24 bp, Homo sapiens
cagaagcaaaaaaacttcattatg

SEQ ID NO: 32383 - DNA, 24 bp, Homo sapiens
acagaagcaaaaaaacttcattat

SEQ ID NO: 32384 - DNA, 24 bp, Homo sapiens
tttaaagaatggtaagctatgtat

SEQ ID NO: 32385 - DNA, 24 bp, Homo sapiens
ttttaaagaatggtaagctatgta

SEQ ID NO: 32386 - DNA, 24 bp, Homo sapiens
attttaaagaatggtaagctatgt

SEQ ID NO: 32387 - DNA, 24 bp, Homo sapiens
gcgagtccgagcctttgtctttct

SEQ ID NO: 32388 - DNA, 23 bp, Homo sapiens
ttggggctggtgcttggtgtctg

SEQ ID NO: 32389 - DNA, 23 bp, Homo sapiens
ccgccttctgcgagcgatgccga

SEQ ID NO: 32390 - DNA, 25 bp, Homo sapiens
ggaccagaggaccaggatgatgaca

SEQ ID NO: 32391 - DNA, 23 bp, Homo sapiens
cggcagctctgtctgtgaaccag

SEQ ID NO: 32392 - DNA, 25 bp, Homo sapiens
gcttattacaacctctgcctcctgg

SEQ ID NO: 32393 - DNA, 24 bp, Homo sapiens
atttattacagaaggaagcttatc

SEQ ID NO: 32394 - DNA, 24 bp, Homo sapiens
tatttattacagaaggaagcttat

SEQ ID NO: 32395 - DNA, 24 bp, Homo sapiens
ctatttattacagaaggaagctta

SEQ ID NO: 32396 - DNA, 24 bp, Homo sapiens
tgtttttacaggaccaaacaacca

SEQ ID NO: 32397 - DNA, 24 bp, Homo sapiens
atgtttttacaggaccaaacaacc

SEQ ID NO: 32398 - DNA, 24 bp, Homo sapiens
catgtttttacaggaccaaacaac

SEQ ID NO: 32399 - DNA, 25 bp, Homo sapiens
caccaccaccaccacaactattaca

SEQ ID NO: 32400 - DNA, 25 bp, Homo sapiens
ctgagacgatgactgaggttcttga

SEQ ID NO: 32401 - DNA, 25 bp, Homo sapiens
tcagttccgacaggtctcacactct

SEQ ID NO: 32402 - DNA, 25 bp, Homo sapiens
agcagtcagttcctggatggtatga

SEQ ID NO: 32403 - DNA, 25 bp, Homo sapiens
ctgagacgatgactgaggttcttga

SEQ ID NO: 32404 - DNA, 25 bp, Homo sapiens
caccaccaccaccacaactattaca

SEQ ID NO: 32405 - DNA, 24 bp, Homo sapiens
agcccgccctgacatgcccgccag

SEQ ID NO: 32406 - DNA, 24 bp, Homo sapiens
cagcccgccctgacatgcccgcca

SEQ ID NO: 32407 - DNA, 24 bp, Homo sapiens
tcagcccgccctgacatgcccgcc

SEQ ID NO: 32408 - DNA, 23 bp, Homo sapiens
gaaaggcacccacagcagcgaag

SEQ ID NO: 32409 - DNA, 24 bp, Homo sapiens
gaaacaatctatgaggcttctggg

SEQ ID NO: 32410 - DNA, 25 bp, Homo sapiens
gtcgtccccgtcggtgaagataaac

SEQ ID NO: 32411 - DNA, 24 bp, Homo sapiens
gctgcaccggcacattatgatgga

SEQ ID NO: 32412 - DNA, 24 bp, Homo sapiens
cagcaccatgcccgcactcctgga

SEQ ID NO: 32413 - DNA, 24 bp, Homo sapiens
gccccgtctgaggtctggcagtca

SEQ ID NO: 32414 - DNA, 24 bp, Homo sapiens
tcgggaagcaggagccagggagta

SEQ ID NO: 32415 - DNA, 24 bp, Homo sapiens
ttcgggaagcaggagccagggagt

SEQ ID NO: 32416 - DNA, 24 bp, Homo sapiens
gttcgggaagcaggagccagggag

SEQ ID NO: 32417 - DNA, 24 bp, Homo sapiens
tagcattacaggtttggttaagtc

SEQ ID NO: 32418 - DNA, 24 bp, Homo sapiens
gtagcattacaggtttggttaagt

SEQ ID NO: 32419 - DNA, 24 bp, Homo sapiens
tgtagcattacaggtttggttaag

SEQ ID NO: 32420 - DNA, 24 bp, Homo sapiens
tcaccgcaaggaatgacatcactc

SEQ ID NO: 32421 - DNA, 24 bp, Homo sapiens
ttcaccgcaaggaatgacatcact

SEQ ID NO: 32422 - DNA, 24 bp, Homo sapiens
tttcaccgcaaggaatgacatcac

SEQ ID NO: 32423 - DNA, 23 bp, Homo sapiens
cggcggctgtggcagagtctgtg

SEQ ID NO: 32424 - DNA, 23 bp, Homo sapiens
ctcgcagcgttgtggaggggcgg

SEQ ID NO: 32425 - DNA, 23 bp, Homo sapiens
cctcgcagagcagccttggggtc

SEQ ID NO: 32426 - DNA, 23 bp, Homo sapiens
cagtcctccctcacagagcccaa

SEQ ID NO: 32427 - DNA, 23 bp, Homo sapiens
caggtctgtggaggtggcagcag

SEQ ID NO: 32428 - DNA, 23 bp, Homo sapiens
ggagatagccgcttcgtcttccg

SEQ ID NO: 32429 - DNA, 23 bp, Homo sapiens
acctgggtcctctcagtgaagcc

SEQ ID NO: 32430 - DNA, 23 bp, Homo sapiens
gccgccccagcagacagtgctac

SEQ ID NO: 32431 - DNA, 23 bp, Homo sapiens
agcagcccagtgaccggcagcca

SEQ ID NO: 32432 - DNA, 24 bp, Homo sapiens
tacagaaaagggtgattaaagtat

SEQ ID NO: 32433 - DNA, 24 bp, Homo sapiens
ctacagaaaagggtgattaaagta

SEQ ID NO: 32434 - DNA, 24 bp, Homo sapiens
tctacagaaaagggtgattaaagt

SEQ ID NO: 32435 - DNA, 24 bp, Homo sapiens
cagcaatgtggcaggcgtgttcta

SEQ ID NO: 32436 - DNA, 24 bp, Homo sapiens
ccacagcaatccatcaacgaagcc

SEQ ID NO: 32437 - DNA, 24 bp, Homo sapiens
tggagagaatggtcgggtggtcag

SEQ ID NO: 32438 - DNA, 24 bp, Homo sapiens
catcagcagccaccagcaggacct

SEQ ID NO: 32439 - DNA, 24 bp, Homo sapiens
gcttggtgctaaattgctgtctca

SEQ ID NO: 32440 - DNA, 24 bp, Homo sapiens
attccgagacactgggaccacagc

SEQ ID NO: 32441 - DNA, 23 bp, Homo sapiens
aatcacgggcagagtccaaacgc

SEQ ID NO: 32442 - DNA, 23 bp, Homo sapiens
cctgctcctgccaccaacactca

SEQ ID NO: 32443 - DNA, 25 bp, Homo sapiens
gctacatacagagaaggctacaacg

SEQ ID NO: 32444 - DNA, 24 bp, Homo sapiens
acagctgggagaagatgtatatga

SEQ ID NO: 32445 - DNA, 24 bp, Homo sapiens
aacagctgggagaagatgtatatg

SEQ ID NO: 32446 - DNA, 24 bp, Homo sapiens
gaacagctgggagaagatgtatat

SEQ ID NO: 32447 - DNA, 24 bp, Homo sapiens
ataaccttcaggggaatgcacata

SEQ ID NO: 32448 - DNA, 24 bp, Homo sapiens
cataaccttcaggggaatgcacat

SEQ ID NO: 32449 - DNA, 24 bp, Homo sapiens
acataaccttcaggggaatgcaca

SEQ ID NO: 32450 - DNA, 24 bp, Homo sapiens
gaaagttgtggatcttttgatgaa

SEQ ID NO: 32451 - DNA, 24 bp, Homo sapiens
agaaagttgtggatcttttgatga

SEQ ID NO: 32452 - DNA, 24 bp, Homo sapiens
cagaaagttgtggatcttttgatg

SEQ ID NO: 32453 - DNA, 24 bp, Homo sapiens
tttgttttcagaaattttatgaat

SEQ ID NO: 32454 - DNA, 24 bp, Homo sapiens
ctttgttttcagaaattttatgaa

SEQ ID NO: 32455 - DNA, 24 bp, Homo sapiens
tctttgttttcagaaattttatga

SEQ ID NO: 32456 - DNA, 24 bp, Homo sapiens
ttttattttagatgaaaaagagaa

SEQ ID NO: 32457 - DNA, 24 bp, Homo sapiens
gttttattttagatgaaaaagaga

SEQ ID NO: 32458 - DNA, 24 bp, Homo sapiens
tgttttattttagatgaaaaagag

SEQ ID NO: 32459 - DNA, 24 bp, Homo sapiens
tgcaatgctctcgaagttccacac

SEQ ID NO: 32460 - DNA, 24 bp, Homo sapiens
catagctcctccgtcagtgctgtg

SEQ ID NO: 32461 - DNA, 23 bp, Homo sapiens
tggctcttggtgtggctgctctc

SEQ ID NO: 32462 - DNA, 23 bp, Homo sapiens
gagaagtggtggcgtgggaatgg

SEQ ID NO: 32463 - DNA, 25 bp, Homo sapiens
aagacaacaaagaagccagtgccct

SEQ ID NO: 32464 - DNA, 25 bp, Homo sapiens
tggaggcatcttcattgttctggct

SEQ ID NO: 32465 - DNA, 24 bp, Homo sapiens
ccatggtgaaggtgttcagctccg

SEQ ID NO: 32466 - DNA, 24 bp, Homo sapiens
gccatggtgaaggtgttcagctcc

SEQ ID NO: 32467 - DNA, 24 bp, Homo sapiens
agccatggtgaaggtgttcagctc

SEQ ID NO: 32468 - DNA, 24 bp, Homo sapiens
cactgaagagggtatgtatggttt

SEQ ID NO: 32469 - DNA, 24 bp, Homo sapiens
tcactgaagagggtatgtatggtt

SEQ ID NO: 32470 - DNA, 24 bp, Homo sapiens
ttcactgaagagggtatgtatggt

SEQ ID NO: 32471 - DNA, 23 bp, Homo sapiens
gggagactgaggctgaggctggg

SEQ ID NO: 32472 - DNA, 24 bp, Homo sapiens
gcctgtacgagctttcgccaaaga

SEQ ID NO: 32473 - DNA, 23 bp, Homo sapiens
ggtctggtggtctctaccgcgaa

SEQ ID NO: 32474 - DNA, 24 bp, Homo sapiens
taattgatcatgtttagtccttat

SEQ ID NO: 32475 - DNA, 24 bp, Homo sapiens
ctaattgatcatgtttagtcctta

SEQ ID NO: 32476 - DNA, 24 bp, Homo sapiens
actaattgatcatgtttagtcctt

SEQ ID NO: 32477 - DNA, 24 bp, Homo sapiens
tattcttctagtatgaagagttaa

SEQ ID NO: 32478 - DNA, 24 bp, Homo sapiens
ttattcttctagtatgaagagtta

SEQ ID NO: 32479 - DNA, 24 bp, Homo sapiens
cttattcttctagtatgaagagtt

SEQ ID NO: 32480 - DNA, 24 bp, Homo sapiens
aaaagaatcagataaatgaaataa

SEQ ID NO: 32481 - DNA, 24 bp, Homo sapiens
caaaagaatcagataaatgaaata

SEQ ID NO: 32482 - DNA, 24 bp, Homo sapiens
acaaaagaatcagataaatgaaat

SEQ ID NO: 32483 - DNA, 25 bp, Homo sapiens
tcagtaaagagaaatcagacccgtg

SEQ ID NO: 32484 - DNA, 23 bp, Homo sapiens
ggagaagttagccagcctagaga

SEQ ID NO: 32485 - DNA, 25 bp, Homo sapiens
tgtataggcaacaggcatctatcat

SEQ ID NO: 32486 - DNA, 24 bp, Homo sapiens
ggaattctcctgcctcagcctctc

SEQ ID NO: 32487 - DNA, 23 bp, Homo sapiens
cccaggctggagggcagtggtac

SEQ ID NO: 32488 - DNA, 23 bp, Homo sapiens
ggctcactgcagcctctgcctcc

SEQ ID NO: 32489 - DNA, 24 bp, Homo sapiens
accattgctgcggaacacgaagaa

SEQ ID NO: 32490 - DNA, 25 bp, Homo sapiens
aggtcagagtctcaggatcgttggt

SEQ ID NO: 32491 - DNA, 23 bp, Homo sapiens
ggagtcatcgctgtggagcaacc

SEQ ID NO: 32492 - DNA, 24 bp, Homo sapiens
ttgtcttacagccatgaacatata

SEQ ID NO: 32493 - DNA, 24 bp, Homo sapiens
tttgtcttacagccatgaacatat

SEQ ID NO: 32494 - DNA, 24 bp, Homo sapiens
atttgtcttacagccatgaacata

SEQ ID NO: 32495 - DNA, 23 bp, Homo sapiens
atctcctgacctcgtgatccgcc

SEQ ID NO: 32496 - DNA, 23 bp, Homo sapiens
ctgtccaacttgcttcccgaggc

SEQ ID NO: 32497 - DNA, 23 bp, Homo sapiens
agcaactgaaagggaggtgaggg

SEQ ID NO: 32498 - DNA, 24 bp, Homo sapiens
tcacagctgaggctgtgaacaacc

SEQ ID NO: 32499 - DNA, 24 bp, Homo sapiens
gtcacagctgaggctgtgaacaac

SEQ ID NO: 32500 - DNA, 24 bp, Homo sapiens
agtcacagctgaggctgtgaacaa

SEQ ID NO: 32501 - DNA, 24 bp, Homo sapiens
gcgtggtagcatgtgcctgtaatc

SEQ ID NO: 32502 - DNA, 24 bp, Homo sapiens
gcagtgacgctagacttcaggaag

SEQ ID NO: 32503 - DNA, 24 bp, Homo sapiens
ctgctcttgactggtgggaccttt

SEQ ID NO: 32504 - DNA, 24 bp, Homo sapiens
ggaggccaaagctgctatcttgga

SEQ ID NO: 32505 - DNA, 24 bp, Homo sapiens
tggaggccaaagctgctatcttgg

SEQ ID NO: 32506 - DNA, 24 bp, Homo sapiens
atggaggccaaagctgctatcttg

SEQ ID NO: 32507 - DNA, 24 bp, Homo sapiens
ggacagccttgtggatgatcgtgt

SEQ ID NO: 32508 - DNA, 24 bp, Homo sapiens
tctatgctgtggtgactgcggtgc

SEQ ID NO: 32509 - DNA, 24 bp, Homo sapiens
gccagaggtccaactacgctttga

SEQ ID NO: 32510 - DNA, 24 bp, Homo sapiens
ctcacccttgctttcccttcagag

SEQ ID NO: 32511 - DNA, 24 bp, Homo sapiens
cctcacccttgctttcccttcaga

SEQ ID NO: 32512 - DNA, 24 bp, Homo sapiens
tcctcacccttgctttcccttcag

SEQ ID NO: 32513 - DNA, 23 bp, Homo sapiens
tggactcgttcatgcagccgttc

SEQ ID NO: 32514 - DNA, 23 bp, Homo sapiens
cactgtggctgctggtggggctg

SEQ ID NO: 32515 - DNA, 23 bp, Homo sapiens
cacgtggtggccgtgatgctgta

SEQ ID NO: 32516 - DNA, 24 bp, Homo sapiens
aggctggtggtgattgtgctgaac

SEQ ID NO: 32517 - DNA, 24 bp, Homo sapiens
ggagaaccatacgctgagcctgag

SEQ ID NO: 32518 - DNA, 24 bp, Homo sapiens
gacaaccatctcagcatcgtcacc

SEQ ID NO: 32519 - DNA, 24 bp, Homo sapiens
gatgagatcgagatgctggagcgg

SEQ ID NO: 32520 - DNA, 24 bp, Homo sapiens
aatcgaggtgatgagcagcaagct

SEQ ID NO: 32521 - DNA, 24 bp, Homo sapiens
catggacttcctgctggccttctc

SEQ ID NO: 32522 - DNA, 24 bp, Homo sapiens
ccgccacagcccctgcccagcccc

SEQ ID NO: 32523 - DNA, 24 bp, Homo sapiens
ccgacggcttccaccgctactacg

SEQ ID NO: 32524 - DNA, 24 bp, Homo sapiens
ccgcttggccttcgaggacgagag

SEQ ID NO: 32525 - DNA, 24 bp, Homo sapiens
aattgtttaaggtacttggtaatc

SEQ ID NO: 32526 - DNA, 24 bp, Homo sapiens
taattgtttaaggtacttggtaat

SEQ ID NO: 32527 - DNA, 24 bp, Homo sapiens
ttaattgtttaaggtacttggtaa

SEQ ID NO: 32528 - DNA, 24 bp, Homo sapiens
ttcaggaagagattataaagactt

SEQ ID NO: 32529 - DNA, 24 bp, Homo sapiens
cttcaggaagagattataaagact

SEQ ID NO: 32530 - DNA, 24 bp, Homo sapiens
gcttcaggaagagattataaagac

SEQ ID NO: 32531 - DNA, 24 bp, Homo sapiens
aaaacagtaaagaattcgagagga

SEQ ID NO: 32532 - DNA, 24 bp, Homo sapiens
taaaacagtaaagaattcgagagg

SEQ ID NO: 32533 - DNA, 24 bp, Homo sapiens
ttaaaacagtaaagaattcgagag

SEQ ID NO: 32534 - DNA, 24 bp, Homo sapiens
caactagagaaaacttcgatatga

SEQ ID NO: 32535 - DNA, 24 bp, Homo sapiens
tcaactagagaaaacttcgatatg

SEQ ID NO: 32536 - DNA, 24 bp, Homo sapiens
ctcaactagagaaaacttcgatat

SEQ ID NO: 32537 - DNA, 24 bp, Homo sapiens
ttccaccttcaagaacgtgcagac

SEQ ID NO: 32538 - DNA, 24 bp, Homo sapiens
gttccaccttcaagaacgtgcaga

SEQ ID NO: 32539 - DNA, 24 bp, Homo sapiens
tgttccaccttcaagaacgtgcag

SEQ ID NO: 32540 - DNA, 24 bp, Homo sapiens
gtcgccgctgccgtctccaagacc

SEQ ID NO: 32541 - DNA, 24 bp, Homo sapiens
gagcttcctaaaggacttcctggc

SEQ ID NO: 32542 - DNA, 24 bp, Homo sapiens
ctagcgtcgcgcagggtcggggac

SEQ ID NO: 32543 - DNA, 24 bp, Homo sapiens
tgaagatttagatgaatgatggac

SEQ ID NO: 32544 - DNA, 24 bp, Homo sapiens
atgaagatttagatgaatgatgga

SEQ ID NO: 32545 - DNA, 24 bp, Homo sapiens
gatgaagatttagatgaatgatgg

SEQ ID NO: 32546 - DNA, 23 bp, Homo sapiens
gctacagcagcagcagaagcagg

SEQ ID NO: 32547 - DNA, 23 bp, Homo sapiens
ctgccacacgctgcgggaatttg

SEQ ID NO: 32548 - DNA, 23 bp, Homo sapiens
ctacctgggctacaccccgcagg

SEQ ID NO: 32549 - DNA, 24 bp, Homo sapiens
gcagtgaatgtttctaatggcaag

SEQ ID NO: 32550 - DNA, 24 bp, Homo sapiens
tgcagtgaatgtttctaatggcaa

SEQ ID NO: 32551 - DNA, 24 bp, Homo sapiens
ctgcagtgaatgtttctaatggca

SEQ ID NO: 32552 - DNA, 24 bp, Homo sapiens
tccttaaatagtgtagaaaaacta

SEQ ID NO: 32553 - DNA, 24 bp, Homo sapiens
ttccttaaatagtgtagaaaaact

SEQ ID NO: 32554 - DNA, 24 bp, Homo sapiens
cttccttaaatagtgtagaaaaac

SEQ ID NO: 32555 - DNA, 24 bp, Homo sapiens
cttttttaaagaaaactggtgatt

SEQ ID NO: 32556 - DNA, 24 bp, Homo sapiens
tcttttttaaagaaaactggtgat

SEQ ID NO: 32557 - DNA, 24 bp, Homo sapiens
ctcttttttaaagaaaactggtga

SEQ ID NO: 32558 - DNA, 23 bp, Homo sapiens
gaggctgctgctgctgctattgt

SEQ ID NO: 32559 - DNA, 24 bp, Homo sapiens
aagccgagaggtgcaggagaagat

SEQ ID NO: 32560 - DNA, 24 bp, Homo sapiens
atgatgcggacctggagaacaagc

SEQ ID NO: 32561 - DNA, 23 bp, Homo sapiens
ccagttctgtgccattgacgagc

SEQ ID NO: 32562 - DNA, 23 bp, Homo sapiens
gtccaccaccactaccactgcca

SEQ ID NO: 32563 - DNA, 23 bp, Homo sapiens
caccatcctcaccaccacagcca

SEQ ID NO: 32564 - DNA, 24 bp, Homo sapiens
cgtcttcacatggcagcaggagag

SEQ ID NO: 32565 - DNA, 23 bp, Homo sapiens
gtacaggacacatggctggagag

SEQ ID NO: 32566 - DNA, 25 bp, Homo sapiens
ttacaatcgtactggaacatgaagg

SEQ ID NO: 32567 - DNA, 24 bp, Homo sapiens
agggaatcgaaagctctaccctcc

SEQ ID NO: 32568 - DNA, 24 bp, Homo sapiens
gagggaatcgaaagctctaccctc

SEQ ID NO: 32569 - DNA, 24 bp, Homo sapiens
cgagggaatcgaaagctctaccct

SEQ ID NO: 32570 - DNA, 24 bp, Homo sapiens
tcttctgccagggattgatgtgaa

SEQ ID NO: 32571 - DNA, 24 bp, Homo sapiens
atcttctgccagggattgatgtga

SEQ ID NO: 32572 - DNA, 24 bp, Homo sapiens
catcttctgccagggattgatgtg

SEQ ID NO: 32573 - DNA, 25 bp, Homo sapiens
tgtgtggaatggttgctgctttaag

SEQ ID NO: 32574 - DNA, 25 bp, Homo sapiens
ctattaaagctaccttaatttggcg

SEQ ID NO: 32575 - DNA, 23 bp, Homo sapiens
tttcttaatcatgtttctgacaa

SEQ ID NO: 32576 - DNA, 23 bp, Homo sapiens
ggagattctgcgggttcactgcc

SEQ ID NO: 32577 - DNA, 23 bp, Homo sapiens
cacgatgctgctggactccgagg

SEQ ID NO: 32578 - DNA, 24 bp, Homo sapiens
agagccagggtgacgagaacaagt

SEQ ID NO: 32579 - DNA, 24 bp, Homo sapiens
atgaggaacagcggacagtggacc

SEQ ID NO: 32580 - DNA, 24 bp, Homo sapiens
tgtcggatctgtctctcatcggct

SEQ ID NO: 32581 - DNA, 24 bp, Homo sapiens
ctacagcctcctgctcatggtcac

SEQ ID NO: 32582 - DNA, 24 bp, Homo sapiens
tcatccagaaggacacctccgacg

SEQ ID NO: 32583 - DNA, 23 bp, Homo sapiens
cctgctgcgtgctggaggtgctc

SEQ ID NO: 32584 - DNA, 23 bp, Homo sapiens
ctgcggcgacatcaagagggaaa

SEQ ID NO: 32585 - DNA, 24 bp, Homo sapiens
tccggggctgcggctgtaactgca

SEQ ID NO: 32586 - DNA, 24 bp, Homo sapiens
ccggcacgcgctgggtactcgggg

SEQ ID NO: 32587 - DNA, 24 bp, Homo sapiens
gccggcgcaccggcgccgcctgcc

SEQ ID NO: 32588 - DNA, 23 bp, Homo sapiens
gatctggcgtgtggagaagttcg

SEQ ID NO: 32589 - DNA, 23 bp, Homo sapiens
gcccgtgcccaccaacctttatg

SEQ ID NO: 32590 - DNA, 25 bp, Homo sapiens
gcctacgtcatcctgaagacagtgc

SEQ ID NO: 32591 - DNA, 23 bp, Homo sapiens
gcagtggcacgatctcagctcac

SEQ ID NO: 32592 - DNA, 25 bp, Homo sapiens
acaatgcttcagtgaacatccttgc

SEQ ID NO: 32593 - DNA, 24 bp, Homo sapiens
cttccagatggtgacatgagccac

SEQ ID NO: 32594 - DNA, 23 bp, Homo sapiens
agctcactgcaacctcctcctcc

SEQ ID NO: 32595 - DNA, 24 bp, Homo sapiens
ttggagacaagatcacctttgtag

SEQ ID NO: 32596 - DNA, 24 bp, Homo sapiens
gttggagacaagatcacctttgta

SEQ ID NO: 32597 - DNA, 24 bp, Homo sapiens
tgttggagacaagatcacctttgt

SEQ ID NO: 32598 - DNA, 24 bp, Homo sapiens
tttctttctaggttcaaaatcaaa

SEQ ID NO: 32599 - DNA, 24 bp, Homo sapiens
atttctttctaggttcaaaatcaa

SEQ ID NO: 32600 - DNA, 24 bp, Homo sapiens
catttctttctaggttcaaaatca

SEQ ID NO: 32601 - DNA, 24 bp, Homo sapiens
atcaatacaatatcgaatatgaaa

SEQ ID NO: 32602 - DNA, 24 bp, Homo sapiens
catcaatacaatatcgaatatgaa

SEQ ID NO: 32603 - DNA, 24 bp, Homo sapiens
tcatcaatacaatatcgaatatga

SEQ ID NO: 32604 - DNA, 24 bp, Homo sapiens
attttggaggctgagaagtccagg

SEQ ID NO: 32605 - DNA, 24 bp, Homo sapiens
ttaaagcaaaataatttgtttctt

SEQ ID NO: 32606 - DNA, 24 bp, Homo sapiens
agatgaaaaaggtaactgtttatc

SEQ ID NO: 32607 - DNA, 24 bp, Homo sapiens
tagatgaaaaaggtaactgtttat

SEQ ID NO: 32608 - DNA, 24 bp, Homo sapiens
atagatgaaaaaggtaactgttta

SEQ ID NO: 32609 - DNA, 24 bp, Homo sapiens
agttaactcagagatggtgccaaa

SEQ ID NO: 32610 - DNA, 24 bp, Homo sapiens
aagttaactcagagatggtgccaa

SEQ ID NO: 32611 - DNA, 24 bp, Homo sapiens
caagttaactcagagatggtgcca

SEQ ID NO: 32612 - DNA, 24 bp, Homo sapiens
tgaaactggtggtatatatataat

SEQ ID NO: 32613 - DNA, 24 bp, Homo sapiens
gtgaaactggtggtatatatataa

SEQ ID NO: 32614 - DNA, 24 bp, Homo sapiens
cgtgaaactggtggtatatatata

SEQ ID NO: 32615 - DNA, 24 bp, Homo sapiens
acatacagaaactttgctggcagg

SEQ ID NO: 32616 - DNA, 24 bp, Homo sapiens
tggcagacttggagacttcttcgg

SEQ ID NO: 32617 - DNA, 24 bp, Homo sapiens
gcaagtcacattcaagaaagccga

SEQ ID NO: 32618 - DNA, 24 bp, Homo sapiens
tctttttcaagatgatgattattc

SEQ ID NO: 32619 - DNA, 24 bp, Homo sapiens
ttctttttcaagatgatgattatt

SEQ ID NO: 32620 - DNA, 24 bp, Homo sapiens
tttctttttcaagatgatgattat

SEQ ID NO: 32621 - DNA, 24 bp, Homo sapiens
tattttgacagtaaaggaagaatg

SEQ ID NO: 32622 - DNA, 24 bp, Homo sapiens
ttattttgacagtaaaggaagaat

SEQ ID NO: 32623 - DNA, 24 bp, Homo sapiens
gttattttgacagtaaaggaagaa

SEQ ID NO: 32624 - DNA, 24 bp, Homo sapiens
tcgagtccatgtgtaaagaactgg

SEQ ID NO: 32625 - DNA, 24 bp, Homo sapiens
ctcgagtccatgtgtaaagaactg

SEQ ID NO: 32626 - DNA, 24 bp, Homo sapiens
tctcgagtccatgtgtaaagaact

SEQ ID NO: 32627 - DNA, 24 bp, Homo sapiens
atcattaagagaccttttttagag

SEQ ID NO: 32628 - DNA, 24 bp, Homo sapiens
catcattaagagaccttttttaga

SEQ ID NO: 32629 - DNA, 24 bp, Homo sapiens
tcatcattaagagaccttttttag

SEQ ID NO: 32630 - DNA, 24 bp, Homo sapiens
agaagattctggtatgtactagca

SEQ ID NO: 32631 - DNA, 24 bp, Homo sapiens
cagaagattctggtatgtactagc

SEQ ID NO: 32632 - DNA, 24 bp, Homo sapiens
acagaagattctggtatgtactag

SEQ ID NO: 32633 - DNA, 24 bp, Homo sapiens
cctctattcaagctatgtatgtca

SEQ ID NO: 32634 - DNA, 24 bp, Homo sapiens
acctctattcaagctatgtatgtc

SEQ ID NO: 32635 - DNA, 24 bp, Homo sapiens
aacctctattcaagctatgtatgt

SEQ ID NO: 32636 - DNA, 24 bp, Homo sapiens
ccatctgagccgccacattctgac

SEQ ID NO: 32637 - DNA, 24 bp, Homo sapiens
ttcatctgctccttccctgactgc

SEQ ID NO: 32638 - DNA, 24 bp, Homo sapiens
gagtcggtgtcgtccttgaccatc

SEQ ID NO: 32639 - DNA, 24 bp, Homo sapiens
tgaacttttagaaaaagaagcaag

SEQ ID NO: 32640 - DNA, 24 bp, Homo sapiens
ctgaacttttagaaaaagaagcaa

SEQ ID NO: 32641 - DNA, 24 bp, Homo sapiens
ctgaacttttagaaaaagaagcaa

SEQ ID NO: 32642 - DNA, 24 bp, Homo sapiens
gaacttaacaggtaagtactgata

SEQ ID NO: 32643 - DNA, 24 bp, Homo sapiens
tgaacttaacaggtaagtactgat

SEQ ID NO: 32644 - DNA, 24 bp, Homo sapiens
atgaacttaacaggtaagtactga

SEQ ID NO: 32645 - DNA, 25 bp, Homo sapiens
catctgaacctgagcctgtagtgcc

SEQ ID NO: 32646 - DNA, 25 bp, Homo sapiens
aggttgaggctgaagatgtggaaga

SEQ ID NO: 32647 - DNA, 24 bp, Homo sapiens
aggtggagaagaggtggatggtgc

SEQ ID NO: 32648 - DNA, 24 bp, Homo sapiens
cattatcgaaggcaattaagttgg

SEQ ID NO: 32649 - DNA, 24 bp, Homo sapiens
tcattatcgaaggcaattaagttg

SEQ ID NO: 32650 - DNA, 24 bp, Homo sapiens
atcattatcgaaggcaattaagtt

SEQ ID NO: 32651 - DNA, 23 bp, Homo sapiens
tccaggagcaggagcagcatgtg

SEQ ID NO: 32652 - DNA, 23 bp, Homo sapiens
tccaggagacagagctgagccag

SEQ ID NO: 32653 - DNA, 23 bp, Homo sapiens
tgaccttgacgcagtgccgatgt

SEQ ID NO: 32654 - DNA, 23 bp, Homo sapiens
ggaggactgaggagcagccaatg

SEQ ID NO: 32655 - DNA, 25 bp, Homo sapiens
cggactaacgtggatctcaagaatg

SEQ ID NO: 32656 - DNA, 25 bp, Homo sapiens
ggcagagaatgagttcctgtcgctg

SEQ ID NO: 32657 - DNA, 24 bp, Homo sapiens
ttttatttcagctgttttcaagtc

SEQ ID NO: 32658 - DNA, 24 bp, Homo sapiens
cttttatttcagctgttttcaagt

SEQ ID NO: 32659 - DNA, 24 bp, Homo sapiens
ccttttatttcagctgttttcaag

SEQ ID NO: 32660 - DNA, 23 bp, Homo sapiens
cgtcctgctcctggtgctggtgg

SEQ ID NO: 32661 - DNA, 25 bp, Homo sapiens
tcttcgtggagttctttgtcaaccc

SEQ ID NO: 32662 - DNA, 23 bp, Homo sapiens
gtgtggttcgtgttcctgcctgc

SEQ ID NO: 32663 - DNA, 24 bp, Homo sapiens
tgttcaccaagtgtcatgaacctg

SEQ ID NO: 32664 - DNA, 24 bp, Homo sapiens
atgttcaccaagtgtcatgaacct

SEQ ID NO: 32665 - DNA, 24 bp, Homo sapiens
tatgttcaccaagtgtcatgaacc

SEQ ID NO: 32666 - DNA, 24 bp, Homo sapiens
aatttctacaggttattcagcaaa

SEQ ID NO: 32667 - DNA, 24 bp, Homo sapiens
gaatttctacaggttattcagcaa

SEQ ID NO: 32668 - DNA, 24 bp, Homo sapiens
agaatttctacaggttattcagca

SEQ ID NO: 32669 - DNA, 24 bp, Homo sapiens
atcctgatgattgcagtcttcacc

SEQ ID NO: 32670 - DNA, 24 bp, Homo sapiens
cccacattcacttggaagaactct

SEQ ID NO: 32671 - DNA, 24 bp, Homo sapiens
agctgtggtgctgctcctgctcgt

SEQ ID NO: 32672 - DNA, 24 bp, Homo sapiens
acaatctgaaggtaaacatggtat

SEQ ID NO: 32673 - DNA, 24 bp, Homo sapiens
cacaatctgaaggtaaacatggta

SEQ ID NO: 32674 - DNA, 24 bp, Homo sapiens
acacaatctgaaggtaaacatggt

SEQ ID NO: 32675 - DNA, 24 bp, Homo sapiens
ggagcacctggagagagacctgcc

SEQ ID NO: 32676 - DNA, 24 bp, Homo sapiens
gggagcacctggagagagacctgc

SEQ ID NO: 32677 - DNA, 24 bp, Homo sapiens
cgggagcacctggagagagacctg

SEQ ID NO: 32678 - DNA, 23 bp, Homo sapiens
ggacagcctggacacggagaaga

SEQ ID NO: 32679 - DNA, 25 bp, Homo sapiens
cttcgccttcctcttcctgttcacc

SEQ ID NO: 32680 - DNA, 24 bp, Homo sapiens
ggcttcttcacagacgaggacaca

SEQ ID NO: 32681 - DNA, 25 bp, Homo sapiens
tgtgttgtagactgtgtcgtgctca

SEQ ID NO: 32682 - DNA, 23 bp, Homo sapiens
gccattctcctgcctcagcctcc

SEQ ID NO: 32683 - DNA, 23 bp, Homo sapiens
gctcattgtccgcaccacgttct

SEQ ID NO: 32684 - DNA, 24 bp, Homo sapiens
gaggtgttgtgctgctgctgtttc

SEQ ID NO: 32685 - DNA, 24 bp, Homo sapiens
cgaggtgttgtgctgctgctgttt

SEQ ID NO: 32686 - DNA, 24 bp, Homo sapiens
tcgaggtgttgtgctgctgctgtt

SEQ ID NO: 32687 - DNA, 23 bp, Homo sapiens
ggttcctttcctggtgctgtccg

SEQ ID NO: 32688 - DNA, 23 bp, Homo sapiens
ggtatccgctcctccctggtcat

SEQ ID NO: 32689 - DNA, 23 bp, Homo sapiens
ctggagccgagtgatggtggact

SEQ ID NO: 32690 - DNA, 23 bp, Homo sapiens
cgaggtgttgtgctgctgctgtt

SEQ ID NO: 32691 - DNA, 23 bp, Homo sapiens
cctgttcggagtgagcctctact

SEQ ID NO: 32692 - DNA, 23 bp, Homo sapiens
atgaatgccatctgctccagtgc

SEQ ID NO: 32693 - DNA, 25 bp, Homo sapiens
ggtggatgacttcattgactggctg

SEQ ID NO: 32694 - DNA, 23 bp, Homo sapiens
cctggcagcatacagcacctctg

SEQ ID NO: 32695 - DNA, 23 bp, Homo sapiens
tacagtggcacaatctcggctca

SEQ ID NO: 32696 - DNA, 23 bp, Homo sapiens
agatggcggcggcagttgtggtg

SEQ ID NO: 32697 - DNA, 23 bp, Homo sapiens
ccggacaggagttgttagtggcc

SEQ ID NO: 32698 - DNA, 23 bp, Homo sapiens
cgtgcagacgtgcgtcatcgccg

SEQ ID NO: 32699 - DNA, 23 bp, Homo sapiens
gcctcttcctgaagcatgtggag

SEQ ID NO: 32700 - DNA, 23 bp, Homo sapiens
cgctgctgctgtcccacaccctg

SEQ ID NO: 32701 - DNA, 23 bp, Homo sapiens
ccagtcgaatgcagatgccgcag

SEQ ID NO: 32702 - DNA, 24 bp, Homo sapiens
atcgtgtcctgtgctgaagatgtt

SEQ ID NO: 32703 - DNA, 23 bp, Homo sapiens
ctgctctgttctgcccggaggag

SEQ ID NO: 32704 - DNA, 23 bp, Homo sapiens
gcctttgagtcagcaaactccgc

SEQ ID NO: 32705 - DNA, 23 bp, Homo sapiens
tctattggagcaggagccgagcc

SEQ ID NO: 32706 - DNA, 24 bp, Homo sapiens
tggcacatttctctcacaccctgg

SEQ ID NO: 32707 - DNA, 25 bp, Homo sapiens
cccactcttgtccctaagctccaga

SEQ ID NO: 32708 - DNA, 23 bp, Homo sapiens
gccttcagtcccacctcccagcg

SEQ ID NO: 32709 - DNA, 23 bp, Homo sapiens
ctcctgttctgctgatggcaccg

SEQ ID NO: 32710 - DNA, 23 bp, Homo sapiens
gggaccccagcagcagcagcccg

SEQ ID NO: 32711 - DNA, 23 bp, Homo sapiens
gcagtggcacaatctcggctcac

SEQ ID NO: 32712 - DNA, 25 bp, Homo sapiens
gctgatgctttgatgcttggttggg

SEQ ID NO: 32713 - DNA, 23 bp, Homo sapiens
cccatcagctttcaggaggcggc

SEQ ID NO: 32714 - DNA, 25 bp, Homo sapiens
aggaggctatggaaagggcaaatgg

SEQ ID NO: 32715 - DNA, 24 bp, Homo sapiens
cacaccaacaccaggcatctacat

SEQ ID NO: 32716 - DNA, 24 bp, Homo sapiens
accgatacagaagacgatcacctt

SEQ ID NO: 32717 - DNA, 24 bp, Homo sapiens
cagacaagggggtgagcctggggg

SEQ ID NO: 32718 - DNA, 24 bp, Homo sapiens
gcagacaagggggtgagcctgggg

SEQ ID NO: 32719 - DNA, 24 bp, Homo sapiens
agcagacaagggggtgagcctggg

SEQ ID NO: 32720 - DNA, 24 bp, Homo sapiens
ttaaggtgccaggtgtcagcctct

SEQ ID NO: 32721 - DNA, 24 bp, Homo sapiens
tgtcaccaagagccagttcctcat

SEQ ID NO: 32722 - DNA, 24 bp, Homo sapiens
tccacggtgtcaacaagcatgagg

SEQ ID NO: 32723 - DNA, 23 bp, Homo sapiens
ggtagatgctgccttccgagagg

SEQ ID NO: 32724 - DNA, 23 bp, Homo sapiens
gaccctgccctacctgccaagtt

SEQ ID NO: 32725 - DNA, 23 bp, Homo sapiens
ggcttcatggtcaacctcttggc

SEQ ID NO: 32726 - DNA, 24 bp, Homo sapiens
gcacatggctctggagaggaactc

SEQ ID NO: 32727 - DNA, 23 bp, Homo sapiens
atctcttctgctcggatggaggc

SEQ ID NO: 32728 - DNA, 23 bp, Homo sapiens
agtcagcagcctcctccctcagc

SEQ ID NO: 32729 - DNA, 24 bp, Homo sapiens
gcaaacgggctaggaggaaagatt

SEQ ID NO: 32730 - DNA, 25 bp, Homo sapiens
gcagcctaatgaaccaacataccgt

SEQ ID NO: 32731 - DNA, 23 bp, Homo sapiens
agtcttgctctgtcacccaggct

SEQ ID NO: 32732 - DNA, 25 bp, Homo sapiens
gcagcctaatgaaccaacataccgt

SEQ ID NO: 32733 - DNA, 25 bp, Homo sapiens
tcaagtgattctcctgcctcagcct

SEQ ID NO: 32734 - DNA, 23 bp, Homo sapiens
agtcttgctctgtcacccaggct

SEQ ID NO: 32735 - DNA, 24 bp, Homo sapiens
tgacagcagcacagcccggcggat

SEQ ID NO: 32736 - DNA, 24 bp, Homo sapiens
ctgacagcagcacagcccggcgga

SEQ ID NO: 32737 - DNA, 24 bp, Homo sapiens
actgacagcagcacagcccggcgg

SEQ ID NO: 32738 - DNA, 24 bp, Homo sapiens
ccatccaagagtcccgcaggtact

SEQ ID NO: 32739 - DNA, 24 bp, Homo sapiens
gccatccaagagtcccgcaggtac

SEQ ID NO: 32740 - DNA, 24 bp, Homo sapiens
agccatccaagagtcccgcaggta

SEQ ID NO: 32741 - DNA, 24 bp, Homo sapiens
ggcacctccagaactccattccct

SEQ ID NO: 32742 - DNA, 23 bp, Homo sapiens
gtccgcatccgacacctggagat

SEQ ID NO: 32743 - DNA, 25 bp, Homo sapiens
gctgctcatcagtgcctggtataat

SEQ ID NO: 32744 - DNA, 23 bp, Homo sapiens
gcaggaccctcagttgacccttg

SEQ ID NO: 32745 - DNA, 23 bp, Homo sapiens
ctcctgccccgaccacagacccc

SEQ ID NO: 32746 - DNA, 23 bp, Homo sapiens
agctgctgatccctggggaggtc

SEQ ID NO: 32747 - DNA, 24 bp, Homo sapiens
aggagcagaggctgggaatccgaa

SEQ ID NO: 32748 - DNA, 24 bp, Homo sapiens
caggagcagaggctgggaatccga

SEQ ID NO: 32749 - DNA, 24 bp, Homo sapiens
acaggagcagaggctgggaatccg

SEQ ID NO: 32750 - DNA, 25 bp, Homo sapiens
tgtgtccaataagatcaacgcaggc

SEQ ID NO: 32751 - DNA, 23 bp, Homo sapiens
gtgtggtggtgtgtgaggctgac

SEQ ID NO: 32752 - DNA, 24 bp, Homo sapiens
accctttcttcgtcctcaacagtg

SEQ ID NO: 32753 - DNA, 23 bp, Homo sapiens
tgcagcctacgtccattgagaag

SEQ ID NO: 32754 - DNA, 25 bp, Homo sapiens
tgtgtccaataagatcaacgcaggc

SEQ ID NO: 32755 - DNA, 23 bp, Homo sapiens
gtgtggtggtgtgtgaggctgac

SEQ ID NO: 32756 - DNA, 24 bp, Homo sapiens
cagagaggaagattcagtttaagg

SEQ ID NO: 32757 - DNA, 24 bp, Homo sapiens
ccagagaggaagattcagtttaag

SEQ ID NO: 32758 - DNA, 24 bp, Homo sapiens
gccagagaggaagattcagtttaa

SEQ ID NO: 32759 - DNA, 24 bp, Homo sapiens
ctgcgtgggaggatttgtcttagg

SEQ ID NO: 32760 - DNA, 24 bp, Homo sapiens
cctgcgtgggaggatttgtcttag

SEQ ID NO: 32761 - DNA, 24 bp, Homo sapiens
gcctgcgtgggaggatttgtctta

SEQ ID NO: 32762 - DNA, 23 bp, Homo sapiens
acaatgcctgtcaccaactgtcc

SEQ ID NO: 32763 - DNA, 25 bp, Homo sapiens
accttctgcgatcctgtcattgaga

SEQ ID NO: 32764 - DNA, 23 bp, Homo sapiens
gcagaggcaggaacgcatcttct

SEQ ID NO: 32765 - DNA, 23 bp, Homo sapiens
gcagaggcaggaacgcatcttct

SEQ ID NO: 32766 - DNA, 23 bp, Homo sapiens
gcttcgcagatgaacctcggcat

SEQ ID NO: 32767 - DNA, 24 bp, Homo sapiens
gccactcccagtaatttcctgccc

SEQ ID NO: 32768 - DNA, 23 bp, Homo sapiens
gctgctgcctggaggagaaggtg

SEQ ID NO: 32769 - DNA, 25 bp, Homo sapiens
gatgactacttgtcctaccacgagc

SEQ ID NO: 32770 - DNA, 24 bp, Homo sapiens
gccatcctctctgccctcttgcta

SEQ ID NO: 32771 - DNA, 24 bp, Homo sapiens
agcactggcaggtgcccttccccc

SEQ ID NO: 32772 - DNA, 24 bp, Homo sapiens
gagcactggcaggtgcccttcccc

SEQ ID NO: 32773 - DNA, 24 bp, Homo sapiens
cgagcactggcaggtgcccttccc

SEQ ID NO: 32774 - DNA, 24 bp, Homo sapiens
taacaaatcaggtaaactatatat

SEQ ID NO: 32775 - DNA, 24 bp, Homo sapiens
ctaacaaatcaggtaaactatata

SEQ ID NO: 32776 - DNA, 24 bp, Homo sapiens
tctaacaaatcaggtaaactatat

SEQ ID NO: 32777 - DNA, 24 bp, Homo sapiens
acattttcaatgtaaaaagatata

SEQ ID NO: 32778 - DNA, 24 bp, Homo sapiens
aacattttcaatgtaaaaagatat

SEQ ID NO: 32779 - DNA, 24 bp, Homo sapiens
caacattttcaatgtaaaaagata

SEQ ID NO: 32780 - DNA, 24 bp, Homo sapiens
tattcttgtaggattatttaacca

SEQ ID NO: 32781 - DNA, 24 bp, Homo sapiens
atattcttgtaggattatttaacc

SEQ ID NO: 32782 - DNA, 24 bp, Homo sapiens
tatattcttgtaggattatttaac

SEQ ID NO: 32783 - DNA, 24 bp, Homo sapiens
caatcccaagttgccaaacatcag

SEQ ID NO: 32784 - DNA, 24 bp, Homo sapiens
tcaatcccaagttgccaaacatca

SEQ ID NO: 32785 - DNA, 24 bp, Homo sapiens
atcaatcccaagttgccaaacatc

SEQ ID NO: 32786 - DNA, 24 bp, Homo sapiens
aaataatgatggaaaaattgaggc

SEQ ID NO: 32787 - DNA, 24 bp, Homo sapiens
aaaataatgatggaaaaattgagg

SEQ ID NO: 32788 - DNA, 24 bp, Homo sapiens
aaaaataatgatggaaaaattgag

SEQ ID NO: 32789 - DNA, 24 bp, Homo sapiens
catttttacagggaattgacatag

SEQ ID NO: 32790 - DNA, 24 bp, Homo sapiens
tcatttttacagggaattgacata

SEQ ID NO: 32791 - DNA, 24 bp, Homo sapiens
ttcatttttacagggaattgacat

SEQ ID NO: 32792 - DNA, 24 bp, Homo sapiens
gaaataaaaaggtatgatttatac

SEQ ID NO: 32793 - DNA, 24 bp, Homo sapiens
agaaataaaaaggtatgatttata

SEQ ID NO: 32794 - DNA, 24 bp, Homo sapiens
aagaaataaaaaggtatgatttat

SEQ ID NO: 32795 - DNA, 23 bp, Homo sapiens
actacatccagcacgagtgggct

SEQ ID NO: 32796 - DNA, 23 bp, Homo sapiens
acacacaatggacgagcttgccg

SEQ ID NO: 32797 - DNA, 23 bp, Homo sapiens
cacggcaggcacacagcaacgac

SEQ ID NO: 32798 - DNA, 24 bp, Homo sapiens
cacctaatcaggtatattgcaatg

SEQ ID NO: 32799 - DNA, 24 bp, Homo sapiens
tcacctaatcaggtatattgcaat

SEQ ID NO: 32800 - DNA, 24 bp, Homo sapiens
ttcacctaatcaggtatattgcaa

SEQ ID NO: 32801 - DNA, 24 bp, Homo sapiens
tttgatgtctgcttgtggagagac

SEQ ID NO: 32802 - DNA, 24 bp, Homo sapiens
atttgatgtctgcttgtggagaga

SEQ ID NO: 32803 - DNA, 24 bp, Homo sapiens
gatttgatgtctgcttgtggagag

SEQ ID NO: 32804 - DNA, 24 bp, Homo sapiens
attttcaacaggaagaattcagtt

SEQ ID NO: 32805 - DNA, 24 bp, Homo sapiens
cattttcaacaggaagaattcagt

SEQ ID NO: 32806 - DNA, 24 bp, Homo sapiens
tcattttcaacaggaagaattcag

SEQ ID NO: 32807 - DNA, 25 bp, Homo sapiens
gcgaagaacaaatctacaacttggc

SEQ ID NO: 32808 - DNA, 23 bp, Homo sapiens
agataacagtgctgtgccaaaaa

SEQ ID NO: 32809 - DNA, 24 bp, Homo sapiens
gattttctctacaaaaattatcat

SEQ ID NO: 32810 - DNA, 24 bp, Homo sapiens
aagacgtatgcagccgaatacacc

SEQ ID NO: 32811 - DNA, 24 bp, Homo sapiens
ctactgctgctgctgctgctactg

SEQ ID NO: 32812 - DNA, 25 bp, Homo sapiens
tggacaagacttagcagcatataca

SEQ ID NO: 32813 - DNA, 23 bp, Homo sapiens
cccttcgcccgcctggacaaccg

SEQ ID NO: 32814 - DNA, 23 bp, Homo sapiens
ggcagaggcggtggcagcggcgg

SEQ ID NO: 32815 - DNA, 23 bp, Homo sapiens
gctgcctcttcgccctttccctg

SEQ ID NO: 32816 - DNA, 23 bp, Homo sapiens
atgctgcttctcatgtgcttcat

SEQ ID NO: 32817 - DNA, 23 bp, Homo sapiens
gctaatggtcgtcgtcggcatcc

SEQ ID NO: 32818 - DNA, 23 bp, Homo sapiens
gaaatcgcctacccagcagtccg

SEQ ID NO: 32819 - DNA, 24 bp, Homo sapiens
aaaaaaaaaaacaccttttgttct

SEQ ID NO: 32820 - DNA, 24 bp, Homo sapiens
aaaaaaaaaaaacaccttttgttc

SEQ ID NO: 32821 - DNA, 24 bp, Homo sapiens
aaaaaaaaaaaaacaccttttgtt

SEQ ID NO: 32822 - DNA, 24 bp, Homo sapiens
aggaggaggatatcacagggacct

SEQ ID NO: 32823 - DNA, 24 bp, Homo sapiens
gaggaggaggatatcacagggacc

SEQ ID NO: 32824 - DNA, 24 bp, Homo sapiens
ggaggaggaggatatcacagggac

SEQ ID NO: 32825 - DNA, 23 bp, Homo sapiens
ggaggcagtgagagcagacatct

SEQ ID NO: 32826 - DNA, 23 bp, Homo sapiens
gggaaagcaagaacaagggaggc

SEQ ID NO: 32827 - DNA, 24 bp, Homo sapiens
gcggaaggaggaccagtctgtgta

SEQ ID NO: 32828 - DNA, 25 bp, Homo sapiens
ggcggatcacctgagatcaagagtt

SEQ ID NO: 32829 - DNA, 24 bp, Homo sapiens
atagagtgcgtcccaaccgattcg

SEQ ID NO: 32830 - DNA, 23 bp, Homo sapiens
aaagatttattcaggccgggcgc

SEQ ID NO: 32831 - DNA, 25 bp, Homo sapiens
ggcggatcacctgagatcaagagtt

SEQ ID NO: 32832 - DNA, 23 bp, Homo sapiens
aaagatttattcaggccgggcgc

SEQ ID NO: 32833 - DNA, 25 bp, Homo sapiens
gccagggggtcacccagatttttat

SEQ ID NO: 32834 - DNA, 24 bp, Homo sapiens
cattcatggaggaaaatatgcaag

SEQ ID NO: 32835 - DNA, 24 bp, Homo sapiens
acattcatggaggaaaatatgcaa

SEQ ID NO: 32836 - DNA, 24 bp, Homo sapiens
cacattcatggaggaaaatatgca

SEQ ID NO: 32837 - DNA, 24 bp, Homo sapiens
gatttcaccaggtgccgtccggaa

SEQ ID NO: 32838 - DNA, 24 bp, Homo sapiens
agatttcaccaggtgccgtccgga

SEQ ID NO: 32839 - DNA, 24 bp, Homo sapiens
gagatttcaccaggtgccgtccgg

SEQ ID NO: 32840 - DNA, 23 bp, Homo sapiens
gcctgcctcggtcatagtcagcg

SEQ ID NO: 32841 - DNA, 23 bp, Homo sapiens
cccaagacccagccccagccacc

SEQ ID NO: 32842 - DNA, 23 bp, Homo sapiens
caaaggagctggcctcggccctc

SEQ ID NO: 32843 - DNA, 24 bp, Homo sapiens
ccgctgccgtctttgaataccctg

SEQ ID NO: 32844 - DNA, 24 bp, Homo sapiens
tggtggtggtggcagtggacagat

SEQ ID NO: 32845 - DNA, 24 bp, Homo sapiens
tgacatggtataggagtgggtggg

SEQ ID NO: 32846 - DNA, 24 bp, Homo sapiens
gcgttgtgcaggactttattttct

SEQ ID NO: 32847 - DNA, 24 bp, Homo sapiens
ggcgttgtgcaggactttattttc

SEQ ID NO: 32848 - DNA, 24 bp, Homo sapiens
gggcgttgtgcaggactttatttt

SEQ ID NO: 32849 - DNA, 24 bp, Homo sapiens
ggtattacaaggtatttttaattt

SEQ ID NO: 32850 - DNA, 24 bp, Homo sapiens
aggtattacaaggtatttttaatt

SEQ ID NO: 32851 - DNA, 24 bp, Homo sapiens
taggtattacaaggtatttttaat

SEQ ID NO: 32852 - DNA, 24 bp, Homo sapiens
tttcattttagtattctgaagaag

SEQ ID NO: 32853 - DNA, 24 bp, Homo sapiens
ttttcattttagtattctgaagaa

SEQ ID NO: 32854 - DNA, 24 bp, Homo sapiens
tttttcattttagtattctgaaga

SEQ ID NO: 32855 - DNA, 23 bp, Homo sapiens
ccagccactacaggatgtttgtg

SEQ ID NO: 32856 - DNA, 23 bp, Homo sapiens
caagtgggtgcagtgtggaaagg

SEQ ID NO: 32857 - DNA, 23 bp, Homo sapiens
gtcatttactgtggccgggctgg

SEQ ID NO: 32858 - DNA, 24 bp, Homo sapiens
tttcatttaagggagatcggatgt

SEQ ID NO: 32859 - DNA, 24 bp, Homo sapiens
ttttcatttaagggagatcggatg

SEQ ID NO: 32860 - DNA, 24 bp, Homo sapiens
cttttcatttaagggagatcggat

SEQ ID NO: 32861 - DNA, 23 bp, Homo sapiens
cccgcttggttgaacacattggc

SEQ ID NO: 32862 - DNA, 25 bp, Homo sapiens
gcgggatgctttgaacattgaaaca

SEQ ID NO: 32863 - DNA, 25 bp, Homo sapiens
gtgtggatgaggtcaccattgtcaa

SEQ ID NO: 32864 - DNA, 24 bp, Homo sapiens
aaataattgatgtggtaaagactg

SEQ ID NO: 32865 - DNA, 24 bp, Homo sapiens
aaaataattgatgtggtaaagact

SEQ ID NO: 32866 - DNA, 24 bp, Homo sapiens
gaaaataattgatgtggtaaagac

SEQ ID NO: 32867 - DNA, 24 bp, Homo sapiens
atcagaagtgccgtccttatctca

SEQ ID NO: 32868 - DNA, 24 bp, Homo sapiens
ggaggaggacttgaggttgccatt

SEQ ID NO: 32869 - DNA, 24 bp, Homo sapiens
ccttaccaggagcaggaggcacac

SEQ ID NO: 32870 - DNA, 24 bp, Homo sapiens
tgttgtggtggtggatggtgttcg

SEQ ID NO: 32871 - DNA, 24 bp, Homo sapiens
tggcttctctgacaagactcctgc

SEQ ID NO: 32872 - DNA, 24 bp, Homo sapiens
ttgtatctctgccaaccaagccat

SEQ ID NO: 32873 - DNA, 24 bp, Homo sapiens
aatcagggaggcaggctctgagga

SEQ ID NO: 32874 - DNA, 24 bp, Homo sapiens
gaatcagggaggcaggctctgagg

SEQ ID NO: 32875 - DNA, 24 bp, Homo sapiens
ggaatcagggaggcaggctctgag

SEQ ID NO: 32876 - DNA, 24 bp, Homo sapiens
aaagtgatgagggcagcaagcagc

SEQ ID NO: 32877 - DNA, 24 bp, Homo sapiens
aggagcccatctacatcatcacgg

SEQ ID NO: 32878 - DNA, 24 bp, Homo sapiens
ctgccagaaactgtcggtgccctg

SEQ ID NO: 32879 - DNA, 24 bp, Homo sapiens
cttgtgaatagattctctataaag

SEQ ID NO: 32880 - DNA, 24 bp, Homo sapiens
tcttgtgaatagattctctataaa

SEQ ID NO: 32881 - DNA, 24 bp, Homo sapiens
ctcttgtgaatagattctctataa

SEQ ID NO: 32882 - DNA, 24 bp, Homo sapiens
ctgatggtggtgctgctggtcttc

SEQ ID NO: 32883 - DNA, 24 bp, Homo sapiens
ccatcagcgtcctcaatgtcctta

SEQ ID NO: 32884 - DNA, 24 bp, Homo sapiens
gctgtctacgcctgcttcaccttc

SEQ ID NO: 32885 - DNA, 24 bp, Homo sapiens
acaataaccagaatatatagaggc

SEQ ID NO: 32886 - DNA, 24 bp, Homo sapiens
cacaataaccagaatatatagagg

SEQ ID NO: 32887 - DNA, 24 bp, Homo sapiens
gcacaataaccagaatatatagag

SEQ ID NO: 32888 - DNA, 24 bp, Homo sapiens
cagcagcagcagcaggaggaggag

SEQ ID NO: 32889 - DNA, 24 bp, Homo sapiens
cccttttctctcccggccgagccg

SEQ ID NO: 32890 - DNA, 25 bp, Homo sapiens
agcgtagcctcttctcctttaccaa

SEQ ID NO: 32891 - DNA, 23 bp, Homo sapiens
gcttgtccctgtttcgccacagt

SEQ ID NO: 32892 - DNA, 23 bp, Homo sapiens
cttatgagctcggttttcttatg

SEQ ID NO: 32893 - DNA, 24 bp, Homo sapiens
acaaatcaaaggtgttccatgtac

SEQ ID NO: 32894 - DNA, 24 bp, Homo sapiens
aacaaatcaaaggtgttccatgta

SEQ ID NO: 32895 - DNA, 24 bp, Homo sapiens
caacaaatcaaaggtgttccatgt

SEQ ID NO: 32896 - DNA, 24 bp, Homo sapiens
tgctgcaccagattttaacacctt

SEQ ID NO: 32897 - DNA, 24 bp, Homo sapiens
atgctgcaccagattttaacacct

SEQ ID NO: 32898 - DNA, 24 bp, Homo sapiens
tatgctgcaccagattttaacacc

SEQ ID NO: 32899 - DNA, 24 bp, Homo sapiens
ctcctcctctactaatctctgtgt

SEQ ID NO: 32900 - DNA, 24 bp, Homo sapiens
ttaaagatagattgtctgaaacgg

SEQ ID NO: 32901 - DNA, 24 bp, Homo sapiens
tcttcagaaaaataaagattcgaa

SEQ ID NO: 32902 - DNA, 24 bp, Homo sapiens
agtggagaattgtctggagacttt

SEQ ID NO: 32903 - DNA, 24 bp, Homo sapiens
cagtggagaattgtctggagactt

SEQ ID NO: 32904 - DNA, 24 bp, Homo sapiens
tcagtggagaattgtctggagact

SEQ ID NO: 32905 - DNA, 24 bp, Homo sapiens
tttaaatgttggtaagatgattcc

SEQ ID NO: 32906 - DNA, 24 bp, Homo sapiens
atttaaatgttggtaagatgattc

SEQ ID NO: 32907 - DNA, 24 bp, Homo sapiens
aatttaaatgttggtaagatgatt

SEQ ID NO: 32908 - DNA, 24 bp, Homo sapiens
tgtaatactagggttttggatatt

SEQ ID NO: 32909 - DNA, 24 bp, Homo sapiens
ttgtaatactagggttttggatat

SEQ ID NO: 32910 - DNA, 24 bp, Homo sapiens
tttgtaatactagggttttggata

SEQ ID NO: 32911 - DNA, 23 bp, Homo sapiens
agccaccctgcccagccgtcaaa

SEQ ID NO: 32912 - DNA, 25 bp, Homo sapiens
agcattctgtcttgaagggcaggtg

SEQ ID NO: 32913 - DNA, 23 bp, Homo sapiens
tatatatccagatggcatgtgtt

SEQ ID NO: 32914 - DNA, 23 bp, Homo sapiens
agccaccctgcccagccgtcaaa

SEQ ID NO: 32915 - DNA, 25 bp, Homo sapiens
agcattctgtcttgaagggcaggtg

SEQ ID NO: 32916 - DNA, 24 bp, Homo sapiens
atgttactacatgcacttggctgc

SEQ ID NO: 32917 - DNA, 24 bp, Homo sapiens
tgtggctcctggtcagtgtaattc

SEQ ID NO: 32918 - DNA, 24 bp, Homo sapiens
ttcaaagcaacaccaccaccactg

SEQ ID NO: 32919 - DNA, 24 bp, Homo sapiens
ttagttatataagattggaactac

SEQ ID NO: 32920 - DNA, 24 bp, Homo sapiens
acatgcacagaagaaggatggtca

SEQ ID NO: 32921 - DNA, 24 bp, Homo sapiens
ataagccattttcccaggttccta

SEQ ID NO: 32922 - DNA, 24 bp, Homo sapiens
aagttttctattactcctgtgaat

SEQ ID NO: 32923 - DNA, 24 bp, Homo sapiens
tgattcttcctgcctcagcctcct

SEQ ID NO: 32924 - DNA, 23 bp, Homo sapiens
ggcaccatcttagctcaccgcag

SEQ ID NO: 32925 - DNA, 24 bp, Homo sapiens
ttatgtggacactgtaatgcctca

SEQ ID NO: 32926 - DNA, 24 bp, Homo sapiens
acagggctcagatagcagcgacag

SEQ ID NO: 32927 - DNA, 24 bp, Homo sapiens
cacagggctcagatagcagcgaca

SEQ ID NO: 32928 - DNA, 24 bp, Homo sapiens
ccacagggctcagatagcagcgac

SEQ ID NO: 32929 - DNA, 24 bp, Homo sapiens
agtcagtgaaattggccgggtctt

SEQ ID NO: 32930 - DNA, 24 bp, Homo sapiens
cagtcagtgaaattggccgggtct

SEQ ID NO: 32931 - DNA, 24 bp, Homo sapiens
tcagtcagtgaaattggccgggtc

SEQ ID NO: 32932 - DNA, 24 bp, Homo sapiens
tgagccacgtggaatgtcccagcg

SEQ ID NO: 32933 - DNA, 24 bp, Homo sapiens
atgagccacgtggaatgtcccagc

SEQ ID NO: 32934 - DNA, 24 bp, Homo sapiens
catgagccacgtggaatgtcccag

SEQ ID NO: 32935 - DNA, 24 bp, Homo sapiens
ctttctcggtgacagttcgctccc

SEQ ID NO: 32936 - DNA, 23 bp, Homo sapiens
cctgccctcagtcagtgaaattg

SEQ ID NO: 32937 - DNA, 23 bp, Homo sapiens
attagccgccccagcctccctcc

SEQ ID NO: 32938 - DNA, 23 bp, Homo sapiens
tctcggtgacagttcgctccctt

SEQ ID NO: 32939 - DNA, 23 bp, Homo sapiens
tagccgccccagcctccctccgc

SEQ ID NO: 32940 - DNA, 23 bp, Homo sapiens
agttcgctcccttcagcattagc

SEQ ID NO: 32941 - DNA, 23 bp, Homo sapiens
agcctccctccgcccccacagac

SEQ ID NO: 32942 - DNA, 23 bp, Homo sapiens
ttggccgggtcttccgctttctc

SEQ ID NO: 32943 - DNA, 24 bp, Homo sapiens
ttcacttgcaagtaagttacttca

SEQ ID NO: 32944 - DNA, 24 bp, Homo sapiens
attcacttgcaagtaagttacttc

SEQ ID NO: 32945 - DNA, 24 bp, Homo sapiens
cattcacttgcaagtaagttactt

SEQ ID NO: 32946 - DNA, 24 bp, Homo sapiens
accttttctttgattctttcaccc

SEQ ID NO: 32947 - DNA, 24 bp, Homo sapiens
gaccttttctttgattctttcacc

SEQ ID NO: 32948 - DNA, 24 bp, Homo sapiens
tgaccttttctttgattctttcac

SEQ ID NO: 32949 - DNA, 25 bp, Homo sapiens
ctctcagattcaagtggttcaagaa

SEQ ID NO: 32950 - DNA, 25 bp, Homo sapiens
agtccttcggtgtgaaaccagttct

SEQ ID NO: 32951 - DNA, 23 bp, Homo sapiens
cagccagagcccagccttgcctc

SEQ ID NO: 32952 - DNA, 23 bp, Homo sapiens
cctctcccagcctgcccagcccg

SEQ ID NO: 32953 - DNA, 23 bp, Homo sapiens
gggcgcttcggatcctcgcggga

SEQ ID NO: 32954 - DNA, 23 bp, Homo sapiens
gacgggaccgcgagcacaggccg

SEQ ID NO: 32955 - DNA, 24 bp, Homo sapiens
tcagagaattggtaactcagatga

SEQ ID NO: 32956 - DNA, 24 bp, Homo sapiens
atcagagaattggtaactcagatg

SEQ ID NO: 32957 - DNA, 24 bp, Homo sapiens
tatcagagaattggtaactcagat

SEQ ID NO: 32958 - DNA, 24 bp, Homo sapiens
ttattttatagaaaacatagctct

SEQ ID NO: 32959 - DNA, 24 bp, Homo sapiens
tttattttatagaaaacatagctc

SEQ ID NO: 32960 - DNA, 24 bp, Homo sapiens
ttttattttatagaaaacatagct

SEQ ID NO: 32961 - DNA, 24 bp, Homo sapiens
ccgccgtggtgcaaagagttgaaa

SEQ ID NO: 32962 - DNA, 24 bp, Homo sapiens
accgccgtggtgcaaagagttgaa

SEQ ID NO: 32963 - DNA, 24 bp, Homo sapiens
caccgccgtggtgcaaagagttga

SEQ ID NO: 32964 - DNA, 24 bp, Homo sapiens
ccagataagagtgtgcggaaagcg

SEQ ID NO: 32965 - DNA, 24 bp, Homo sapiens
ggaggacggaccagcaggacagac

SEQ ID NO: 32966 - DNA, 24 bp, Homo sapiens
ccatagccgcagcagcgcccgccg

SEQ ID NO: 32967 - DNA, 24 bp, Homo sapiens
ctgttttaaaggacacagatttag

SEQ ID NO: 32968 - DNA, 24 bp, Homo sapiens
gctgttttaaaggacacagattta

SEQ ID NO: 32969 - DNA, 24 bp, Homo sapiens
tgctgttttaaaggacacagattt

SEQ ID NO: 32970 - DNA, 24 bp, Homo sapiens
tttactaacagaattaccgaattg

SEQ ID NO: 32971 - DNA, 24 bp, Homo sapiens
ttttactaacagaattaccgaatt

SEQ ID NO: 32972 - DNA, 24 bp, Homo sapiens
tttttactaacagaattaccgaat

SEQ ID NO: 32973 - DNA, 24 bp, Homo sapiens
gcttaagcaagagagcattaggta

SEQ ID NO: 32974 - DNA, 24 bp, Homo sapiens
agcttaagcaagagagcattaggt

SEQ ID NO: 32975 - DNA, 24 bp, Homo sapiens
cagcttaagcaagagagcattagg

SEQ ID NO: 32976 - DNA, 24 bp, Homo sapiens
tttgatggaggatataagtcaaat

SEQ ID NO: 32977 - DNA, 24 bp, Homo sapiens
atttgatggaggatataagtcaaa

SEQ ID NO: 32978 - DNA, 24 bp, Homo sapiens
tatttgatggaggatataagtcaa

SEQ ID NO: 32979 - DNA, 24 bp, Homo sapiens
tcaggcagcaggagaggccagtgc

SEQ ID NO: 32980 - DNA, 24 bp, Homo sapiens
atcaggcagcaggagaggccagtg

SEQ ID NO: 32981 - DNA, 24 bp, Homo sapiens
aatcaggcagcaggagaggccagt

SEQ ID NO: 32982 - DNA, 25 bp, Homo sapiens
aggttctgtgtctgaagataactca

SEQ ID NO: 32983 - DNA, 25 bp, Homo sapiens
agttggacctactggaggagaagga

SEQ ID NO: 32984 - DNA, 25 bp, Homo sapiens
cttgtcacctgcttctgttggctca

SEQ ID NO: 32985 - DNA, 24 bp, Homo sapiens
cctatggcaaggtatgtttttctt

SEQ ID NO: 32986 - DNA, 24 bp, Homo sapiens
tcctatggcaaggtatgtttttct

SEQ ID NO: 32987 - DNA, 24 bp, Homo sapiens
ctcctatggcaaggtatgtttttc

SEQ ID NO: 32988 - DNA, 24 bp, Homo sapiens
gtgcggctggtgctggctcacttg

SEQ ID NO: 32989 - DNA, 24 bp, Homo sapiens
caaggcagcatcctcctggaacac

SEQ ID NO: 32990 - DNA, 24 bp, Homo sapiens
acaaacactccaggttgctgtggc

SEQ ID NO: 32991 - DNA, 24 bp, Homo sapiens
gctgcctgtgtgggactgagatgc

SEQ ID NO: 32992 - DNA, 24 bp, Homo sapiens
tctcctttgtgacttcaagagcct

SEQ ID NO: 32993 - DNA, 24 bp, Homo sapiens
acctgaatgtgtctgcgttcctgt

SEQ ID NO: 32994 - DNA, 24 bp, Homo sapiens
taaagcctgagacagctgcctgtg

SEQ ID NO: 32995 - DNA, 24 bp, Homo sapiens
tgcaggatttcttcacacctctcc

SEQ ID NO: 32996 - DNA, 24 bp, Homo sapiens
acttcaagagcctctggcatctct

SEQ ID NO: 32997 - DNA, 23 bp, Homo sapiens
cactcccgcccacgtcccatttc

SEQ ID NO: 32998 - DNA, 23 bp, Homo sapiens
cgagcgggagtgggacccagccc

SEQ ID NO: 32999 - DNA, 23 bp, Homo sapiens
ctccccagtgccccgagtgcccc

SEQ ID NO: 33000 - DNA, 24 bp, Homo sapiens
atttgtttcagaattaaagaaaaa

SEQ ID NO: 33001 - DNA, 24 bp, Homo sapiens
tatttgtttcagaattaaagaaaa

SEQ ID NO: 33002 - DNA, 24 bp, Homo sapiens
atatttgtttcagaattaaagaaa

SEQ ID NO: 33003 - DNA, 24 bp, Homo sapiens
gctgccttgtgtgcgactgagatg

SEQ ID NO: 33004 - DNA, 24 bp, Homo sapiens
gcctctgaatctgtctgtgtccct

SEQ ID NO: 33005 - DNA, 24 bp, Homo sapiens
actgacctgtgttccttccctgtt

SEQ ID NO: 33006 - DNA, 24 bp, Homo sapiens
caagttcattgtctggcaccaagc

SEQ ID NO: 33007 - DNA, 24 bp, Homo sapiens
agaggaagaggaagaagaagaaga

SEQ ID NO: 33008 - DNA, 24 bp, Homo sapiens
gaagaagaaactgtctctacacct

SEQ ID NO: 33009 - DNA, 24 bp, Homo sapiens
gctgtggtggtgccttctggagag

SEQ ID NO: 33010 - DNA, 24 bp, Homo sapiens
ctgcggagatcatactgacctggc

SEQ ID NO: 33011 - DNA, 24 bp, Homo sapiens
gcgggtatgaacagtatgcctacg

SEQ ID NO: 33012 - DNA, 24 bp, Homo sapiens
aaaaggccaccgtaagtttaaaat

SEQ ID NO: 33013 - DNA, 24 bp, Homo sapiens
taaaaggccaccgtaagtttaaaa

SEQ ID NO: 33014 - DNA, 24 bp, Homo sapiens
ctaaaaggccaccgtaagtttaaa

SEQ ID NO: 33015 - DNA, 24 bp, Homo sapiens
aaaccaaagggcaagatgtccgct

SEQ ID NO: 33016 - DNA, 24 bp, Homo sapiens
ctgagaggtggaagacgatgtccg

SEQ ID NO: 33017 - DNA, 24 bp, Homo sapiens
aagggaggcaagaagaagaaggat

SEQ ID NO: 33018 - DNA, 24 bp, Homo sapiens
ctctcgtggaggcagctagcgcga

SEQ ID NO: 33019 - DNA, 24 bp, Homo sapiens
gctgagccgcgcgtcgtgccctgc

SEQ ID NO: 33020 - DNA, 24 bp, Homo sapiens
attactccttggtatgttattttc

SEQ ID NO: 33021 - DNA, 24 bp, Homo sapiens
aattactccttggtatgttatttt

SEQ ID NO: 33022 - DNA, 24 bp, Homo sapiens
taattactccttggtatgttattt

SEQ ID NO: 33023 - DNA, 24 bp, Homo sapiens
gtgatgacatgcctctggtggacc

SEQ ID NO: 33024 - DNA, 24 bp, Homo sapiens
tgacagcagaacatcttagtgacg

SEQ ID NO: 33025 - DNA, 24 bp, Homo sapiens
ttgtctgtgctgtgcttgccgatt

SEQ ID NO: 33026 - DNA, 24 bp, Homo sapiens
aactcaaatcggtttgtaaaatga

SEQ ID NO: 33027 - DNA, 24 bp, Homo sapiens
caactcaaatcggtttgtaaaatg

SEQ ID NO: 33028 - DNA, 24 bp, Homo sapiens
ccaactcaaatcggtttgtaaaat

SEQ ID NO: 33029 - DNA, 24 bp, Homo sapiens
tgacccttctgaatctaaacaaaa

SEQ ID NO: 33030 - DNA, 24 bp, Homo sapiens
atgacccttctgaatctaaacaaa

SEQ ID NO: 33031 - DNA, 24 bp, Homo sapiens
aatgacccttctgaatctaaacaa

SEQ ID NO: 33032 - DNA, 24 bp, Homo sapiens
aactcaaatcggcaatacaaactg

SEQ ID NO: 33033 - DNA, 24 bp, Homo sapiens
caactcaaatcggcaatacaaact

SEQ ID NO: 33034 - DNA, 24 bp, Homo sapiens
ccaactcaaatcggcaatacaaac

SEQ ID NO: 33035 - DNA, 24 bp, Homo sapiens
acttagtctcctccctgggtttgg

SEQ ID NO: 33036 - DNA, 24 bp, Homo sapiens
ctctgagcctcggtttccccatct

SEQ ID NO: 33037 - DNA, 24 bp, Homo sapiens
tcctgctttatgtgtgacaccact

SEQ ID NO: 33038 - DNA, 24 bp, Homo sapiens
agagattctcctgcctcagcctcc

SEQ ID NO: 33039 - DNA, 24 bp, Homo sapiens
gctcattgcagcctccacctcctg

SEQ ID NO: 33040 - DNA, 24 bp, Homo sapiens
gcccaggctggagtgcagtggatc

SEQ ID NO: 33041 - DNA, 24 bp, Homo sapiens
aacaccactacgccttcaaccacc

SEQ ID NO: 33042 - DNA, 23 bp, Homo sapiens
aacctcatgtcctcggagcagca

SEQ ID NO: 33043 - DNA, 23 bp, Homo sapiens
ccacagccaccaccaccaccaac

SEQ ID NO: 33044 - DNA, 24 bp, Homo sapiens
gggacaggcagccacccctgagac

SEQ ID NO: 33045 - DNA, 24 bp, Homo sapiens
ggggacaggcagccacccctgaga

SEQ ID NO: 33046 - DNA, 24 bp, Homo sapiens
aggggacaggcagccacccctgag

SEQ ID NO: 33047 - DNA, 24 bp, Homo sapiens
gaggactacatcaacgaccgccag

SEQ ID NO: 33048 - DNA, 23 bp, Homo sapiens
cgagcagatccagttcatcaagc

SEQ ID NO: 33049 - DNA, 23 bp, Homo sapiens
ctgctgctgctgctgcccacctt

SEQ ID NO: 33050 - DNA, 24 bp, Homo sapiens
caggtgtcgagcctccttccccag

SEQ ID NO: 33051 - DNA, 24 bp, Homo sapiens
tgccgaggcagcttcattgaggcc

SEQ ID NO: 33052 - DNA, 24 bp, Homo sapiens
gccccctgccccccagccctactg

SEQ ID NO: 33053 - DNA, 24 bp, Homo sapiens
tttctcaacagaacaagacttaaa

SEQ ID NO: 33054 - DNA, 24 bp, Homo sapiens
atttctcaacagaacaagacttaa

SEQ ID NO: 33055 - DNA, 24 bp, Homo sapiens
gatttctcaacagaacaagactta

SEQ ID NO: 33056 - DNA, 25 bp, Homo sapiens
tgactataaagaaaaacagatgcta

SEQ ID NO: 33057 - DNA, 25 bp, Homo sapiens
cagtgctggcaatggtgatgatgga

SEQ ID NO: 33058 - DNA, 25 bp, Homo sapiens
aagaagcatggaagtaatcctgtgg

SEQ ID NO: 33059 - DNA, 25 bp, Homo sapiens
aggactgtgatagagaggttgaaga

SEQ ID NO: 33060 - DNA, 24 bp, Homo sapiens
atttaaaccaggtatatattttgt

SEQ ID NO: 33061 - DNA, 24 bp, Homo sapiens
tatttaaaccaggtatatattttg

SEQ ID NO: 33062 - DNA, 24 bp, Homo sapiens
ttatttaaaccaggtatatatttt

SEQ ID NO: 33063 - DNA, 23 bp, Homo sapiens
ctctaagccgctggtcgtcctgc

SEQ ID NO: 33064 - DNA, 25 bp, Homo sapiens
ggttctctgcttcactaactcccga

SEQ ID NO: 33065 - DNA, 23 bp, Homo sapiens
ggtgtggacgtggctgagttctc

SEQ ID NO: 33066 - DNA, 24 bp, Homo sapiens
acgaaaccaaggtggctatggcgg

SEQ ID NO: 33067 - DNA, 24 bp, Homo sapiens
cacgaaaccaaggtggctatggcg

SEQ ID NO: 33068 - DNA, 24 bp, Homo sapiens
ccacgaaaccaaggtggctatggc

SEQ ID NO: 33069 - DNA, 24 bp, Homo sapiens
aagaggtggtggccccagtcaaaa

SEQ ID NO: 33070 - DNA, 24 bp, Homo sapiens
gaagaggtggtggccccagtcaaa

SEQ ID NO: 33071 - DNA, 24 bp, Homo sapiens
ggaagaggtggtggccccagtcaa

SEQ ID NO: 33072 - DNA, 24 bp, Homo sapiens
tagagagggcaggcagagtggtga

SEQ ID NO: 33073 - DNA, 24 bp, Homo sapiens
ccgagatggattgggtgttgaagc

SEQ ID NO: 33074 - DNA, 24 bp, Homo sapiens
cctgccctggtcctgctctgttga

SEQ ID NO: 33075 - DNA, 24 bp, Homo sapiens
gtataacagcattggcagaggagc

SEQ ID NO: 33076 - DNA, 24 bp, Homo sapiens
acaaggaaagaatagggcacaggt

SEQ ID NO: 33077 - DNA, 24 bp, Homo sapiens
cttctcagggttggaaatcgtgcc

SEQ ID NO: 33078 - DNA, 23 bp, Homo sapiens
ccgctcgaatctgatgctgtgga

SEQ ID NO: 33079 - DNA, 25 bp, Homo sapiens
ttgactgcgagttgaggctgttgat

SEQ ID NO: 33080 - DNA, 24 bp, Homo sapiens
gagtctagcaggaggaattattgg

SEQ ID NO: 33081 - DNA, 24 bp, Homo sapiens
aaagaaattaagcgaatgcggaaa

SEQ ID NO: 33082 - DNA, 24 bp, Homo sapiens
aaaagaaattaagcgaatgcggaa

SEQ ID NO: 33083 - DNA, 24 bp, Homo sapiens
gaaaagaaattaagcgaatgcgga

SEQ ID NO: 33084 - DNA, 24 bp, Homo sapiens
caatgctggcacctacggctactg

SEQ ID NO: 33085 - DNA, 25 bp, Homo sapiens
gcaacacagcccatttcccagtagt

SEQ ID NO: 33086 - DNA, 25 bp, Homo sapiens
tgtcctcatctccttcttgctttgc

SEQ ID NO: 33087 - DNA, 25 bp, Homo sapiens
atgaagttcgtattggctggtcact

SEQ ID NO: 33088 - DNA, 25 bp, Homo sapiens
gaagagcatcctatggtgtgtcaaa

SEQ ID NO: 33089 - DNA, 25 bp, Homo sapiens
tcgtctcagtgcttcttcccttaca

SEQ ID NO: 33090 - DNA, 24 bp, Homo sapiens
ttttcagacaagtacagagtgaga

SEQ ID NO: 33091 - DNA, 24 bp, Homo sapiens
cttttcagacaagtacagagtgag

SEQ ID NO: 33092 - DNA, 24 bp, Homo sapiens
ccttttcagacaagtacagagtga

SEQ ID NO: 33093 - DNA, 24 bp, Homo sapiens
accaccgtgttaatcagaagacca

SEQ ID NO: 33094 - DNA, 24 bp, Homo sapiens
gtggtgattgtggagtctggctgg

SEQ ID NO: 33095 - DNA, 24 bp, Homo sapiens
acgatgacctgatccacttctcca

SEQ ID NO: 33096 - DNA, 23 bp, Homo sapiens
cggcggcggtggcggttactacg

SEQ ID NO: 33097 - DNA, 23 bp, Homo sapiens
cccttccgagagcagcaaagcct

SEQ ID NO: 33098 - DNA, 23 bp, Homo sapiens
cccatagacctgtggctagacgc

SEQ ID NO: 33099 - DNA, 24 bp, Homo sapiens
ttcgggacattaccaaaccactca

SEQ ID NO: 33100 - DNA, 24 bp, Homo sapiens
gggtgatgatggctgtgtgaacga

SEQ ID NO: 33101 - DNA, 24 bp, Homo sapiens
tcacctactacatccgctactgcc

SEQ ID NO: 33102 - DNA, 24 bp, Homo sapiens
gctcctccgctgtagtattgctcc

SEQ ID NO: 33103 - DNA, 24 bp, Homo sapiens
cgcaatgtaactccgaactcgtac

SEQ ID NO: 33104 - DNA, 24 bp, Homo sapiens
cccagcctcgccctcaacacctat

SEQ ID NO: 33105 - DNA, 24 bp, Homo sapiens
accagtgtaagaactactacaaac

SEQ ID NO: 33106 - DNA, 24 bp, Homo sapiens
cacatggctatgtggagcactcgg

SEQ ID NO: 33107 - DNA, 24 bp, Homo sapiens
atgacggctgcccgaagccccccg

SEQ ID NO: 33108 - DNA, 24 bp, Homo sapiens
acaactgagagacacttttagaaa

SEQ ID NO: 33109 - DNA, 24 bp, Homo sapiens
aacaactgagagacacttttagaa

SEQ ID NO: 33110 - DNA, 24 bp, Homo sapiens
caacaactgagagacacttttaga

SEQ ID NO: 33111 - DNA, 24 bp, Homo sapiens
cgctcggctcatggtctttgacaa

SEQ ID NO: 33112 - DNA, 23 bp, Homo sapiens
gacgtggcggctgctgtgctcct

SEQ ID NO: 33113 - DNA, 23 bp, Homo sapiens
caacgccagggtagccggactca

SEQ ID NO: 33114 - DNA, 23 bp, Homo sapiens
aacgccagggtagccggactcag

SEQ ID NO: 33115 - DNA, 23 bp, Homo sapiens
cgtggcggctgctgtgctcctcg

SEQ ID NO: 33116 - DNA, 23 bp, Homo sapiens
ctctgcggacgctcggctcatgg

SEQ ID NO: 33117 - DNA, 25 bp, Homo sapiens
ttaggaggcagaggcaggaagattg

SEQ ID NO: 33118 - DNA, 24 bp, Homo sapiens
tccgacctgagtccttgagtctgg

SEQ ID NO: 33119 - DNA, 25 bp, Homo sapiens
gctctgtaatcccacctgtaatccc

SEQ ID NO: 33120 - DNA, 23 bp, Homo sapiens
cgtggcggctgctgtgctcctcg

SEQ ID NO: 33121 - DNA, 24 bp, Homo sapiens
cgctcggctcatggtctttgacaa

SEQ ID NO: 33122 - DNA, 23 bp, Homo sapiens
aacgccagggtagccggactcag

SEQ ID NO: 33123 - DNA, 24 bp, Homo sapiens
ttgctgacctgctggattacatca

SEQ ID NO: 33124 - DNA, 24 bp, Homo sapiens
gatgtgatgaaggagatgggaggc

SEQ ID NO: 33125 - DNA, 24 bp, Homo sapiens
tgctgaggatttggaaagggtgtt

SEQ ID NO: 33126 - DNA, 24 bp, Homo sapiens
gtctcactgtcttactggctctgc

SEQ ID NO: 33127 - DNA, 24 bp, Homo sapiens
ctcttcacaggcattctgaccacg

SEQ ID NO: 33128 - DNA, 24 bp, Homo sapiens
ccaccaccaccactaccaccatca

SEQ ID NO: 33129 - DNA, 23 bp, Homo sapiens
gtggtgactgtggatggcgtgag

SEQ ID NO: 33130 - DNA, 25 bp, Homo sapiens
cgtctctgctggttcagttcgatca

SEQ ID NO: 33131 - DNA, 25 bp, Homo sapiens
cgaccacgtcctgcataagaccatc

SEQ ID NO: 33132 - DNA, 24 bp, Homo sapiens
cctggtggtggtcctgagcactat

SEQ ID NO: 33133 - DNA, 24 bp, Homo sapiens
ggctcaacctgctggtgctgtatg

SEQ ID NO: 33134 - DNA, 24 bp, Homo sapiens
ctctcggtggcggacttgatcgtg

SEQ ID NO: 33135 - DNA, 24 bp, Homo sapiens
tggaacgtcaggtgctgctgagcg

SEQ ID NO: 33136 - DNA, 24 bp, Homo sapiens
atggaacgtcaggtgctgctgagc

SEQ ID NO: 33137 - DNA, 24 bp, Homo sapiens
tatggaacgtcaggtgctgctgag

SEQ ID NO: 33138 - DNA, 23 bp, Homo sapiens
gtggacgtgctggtgtctgagtg

SEQ ID NO: 33139 - DNA, 23 bp, Homo sapiens
gaaggtggaggatgtggtgctgc

SEQ ID NO: 33140 - DNA, 23 bp, Homo sapiens
cagtgagatggcacagcacacgg

SEQ ID NO: 33141 - DNA, 24 bp, Homo sapiens
gcgtggctgaggtgtcctgtggcc

SEQ ID NO: 33142 - DNA, 24 bp, Homo sapiens
ggcgtggctgaggtgtcctgtggc

SEQ ID NO: 33143 - DNA, 24 bp, Homo sapiens
aggcgtggctgaggtgtcctgtgg

SEQ ID NO: 33144 - DNA, 24 bp, Homo sapiens
tttggggtccacttgagcctgatc

SEQ ID NO: 33145 - DNA, 24 bp, Homo sapiens
ctttggggtccacttgagcctgat

SEQ ID NO: 33146 - DNA, 24 bp, Homo sapiens
cctttggggtccacttgagcctga

SEQ ID NO: 33147 - DNA, 24 bp, Homo sapiens
atggaatcaaggcagaaaggtctc

SEQ ID NO: 33148 - DNA, 24 bp, Homo sapiens
tatggaatcaaggcagaaaggtct

SEQ ID NO: 33149 - DNA, 24 bp, Homo sapiens
atatggaatcaaggcagaaaggtc

SEQ ID NO: 33150 - DNA, 24 bp, Homo sapiens
ccaaagcaaagcagctcaccaagc

SEQ ID NO: 33151 - DNA, 24 bp, Homo sapiens
aactctgtagctttcacatctgac

SEQ ID NO: 33152 - DNA, 24 bp, Homo sapiens
aaactatgcctcaagattgcttgg

SEQ ID NO: 33153 - DNA, 24 bp, Homo sapiens
ctcttaatcaggtaagattgtatt

SEQ ID NO: 33154 - DNA, 24 bp, Homo sapiens
tctcttaatcaggtaagattgtat

SEQ ID NO: 33155 - DNA, 24 bp, Homo sapiens
ctctcttaatcaggtaagattgta

SEQ ID NO: 33156 - DNA, 24 bp, Homo sapiens
gatgtggcaatttcagctagtgaa

SEQ ID NO: 33157 - DNA, 24 bp, Homo sapiens
atgtttgaagaaaccaggaactat

SEQ ID NO: 33158 - DNA, 24 bp, Homo sapiens
aaacaaagaaaagcttttggcaaa

SEQ ID NO: 33159 - DNA, 24 bp, Homo sapiens
cacaatcaatggtgtcccagatga

SEQ ID NO: 33160 - DNA, 24 bp, Homo sapiens
tcacaatcaatggtgtcccagatg

SEQ ID NO: 33161 - DNA, 24 bp, Homo sapiens
gtcacaatcaatggtgtcccagat

SEQ ID NO: 33162 - DNA, 24 bp, Homo sapiens
ttctcaaacagtttaaacagattt

SEQ ID NO: 33163 - DNA, 24 bp, Homo sapiens
tttctcaaacagtttaaacagatt

SEQ ID NO: 33164 - DNA, 24 bp, Homo sapiens
ttttctcaaacagtttaaacagat

SEQ ID NO: 33165 - DNA, 24 bp, Homo sapiens
actatgaataggtaagtatattac

SEQ ID NO: 33166 - DNA, 24 bp, Homo sapiens
aactatgaataggtaagtatatta

SEQ ID NO: 33167 - DNA, 24 bp, Homo sapiens
gaactatgaataggtaagtatatt

SEQ ID NO: 33168 - DNA, 24 bp, Homo sapiens
gaatgttcaagattctggacaagt

SEQ ID NO: 33169 - DNA, 24 bp, Homo sapiens
agaatgttcaagattctggacaag

SEQ ID NO: 33170 - DNA, 24 bp, Homo sapiens
gagaatgttcaagattctggacaa

SEQ ID NO: 33171 - DNA, 24 bp, Homo sapiens
atgtcttacagatcagaagcaatc

SEQ ID NO: 33172 - DNA, 24 bp, Homo sapiens
aatgtcttacagatcagaagcaat

SEQ ID NO: 33173 - DNA, 24 bp, Homo sapiens
aaatgtcttacagatcagaagcaa

SEQ ID NO: 33174 - DNA, 23 bp, Homo sapiens
tgtagtggcaggctgaggcatga

SEQ ID NO: 33175 - DNA, 25 bp, Homo sapiens
ggcagatcacttgaggtcaggagtt

SEQ ID NO: 33176 - DNA, 23 bp, Homo sapiens
ttgtccttggaatgactcagtgc

SEQ ID NO: 33177 - DNA, 24 bp, Homo sapiens
tctattccaacaaggagattttcc

SEQ ID NO: 33178 - DNA, 24 bp, Homo sapiens
ttgcccaactcatgtccctcatca

SEQ ID NO: 33179 - DNA, 24 bp, Homo sapiens
atggagaggaggaggtggagactt

SEQ ID NO: 33180 - DNA, 24 bp, Homo sapiens
ttttcttctagggaagaacagtga

SEQ ID NO: 33181 - DNA, 24 bp, Homo sapiens
tttttcttctagggaagaacagtg

SEQ ID NO: 33182 - DNA, 24 bp, Homo sapiens
ttttttcttctagggaagaacagt

SEQ ID NO: 33183 - DNA, 24 bp, Homo sapiens
gggcctgctcgcaatgccagcaca

SEQ ID NO: 33184 - DNA, 24 bp, Homo sapiens
ggggcctgctcgcaatgccagcac

SEQ ID NO: 33185 - DNA, 24 bp, Homo sapiens
tggggcctgctcgcaatgccagca

SEQ ID NO: 33186 - DNA, 24 bp, Homo sapiens
gcccggagcgagcgagcgagagag

SEQ ID NO: 33187 - DNA, 24 bp, Homo sapiens
gcgctgctgctggcgctgctgctg

SEQ ID NO: 33188 - DNA, 24 bp, Homo sapiens
gggccgggccatggggtggcgggc

SEQ ID NO: 33189 - DNA, 23 bp, Homo sapiens
gcgagcttctccagaccgacctt

SEQ ID NO: 33190 - DNA, 23 bp, Homo sapiens
gccgcccgccgccgctccagaag

SEQ ID NO: 33191 - DNA, 23 bp, Homo sapiens
cgacgcccgcgaaggctgttgag

SEQ ID NO: 33192 - DNA, 24 bp, Homo sapiens
ggcgtggcgaagtgaagaggaacc

SEQ ID NO: 33193 - DNA, 24 bp, Homo sapiens
gcagccgtgttaaggagaggacat

SEQ ID NO: 33194 - DNA, 24 bp, Homo sapiens
agtgcagtgacgtgatctcggctc

SEQ ID NO: 33195 - DNA, 24 bp, Homo sapiens
cacatgaaaaggaaaagcatcatt

SEQ ID NO: 33196 - DNA, 24 bp, Homo sapiens
tcacatgaaaaggaaaagcatcat

SEQ ID NO: 33197 - DNA, 24 bp, Homo sapiens
ttcacatgaaaaggaaaagcatca

SEQ ID NO: 33198 - DNA, 24 bp, Homo sapiens
agcaatcatggtgaacctgaggaa

SEQ ID NO: 33199 - DNA, 24 bp, Homo sapiens
cctagcctgttaatttcgtcttct

SEQ ID NO: 33200 - DNA, 24 bp, Homo sapiens
ttttaaactttggttgcttaagac

SEQ ID NO: 33201 - DNA, 23 bp, Homo sapiens
agtggagaaggtggtgctgctca

SEQ ID NO: 33202 - DNA, 23 bp, Homo sapiens
cctgctggtgatggtggctgtgt

SEQ ID NO: 33203 - DNA, 24 bp, Homo sapiens
gtcttgttcggacatctctggacg

SEQ ID NO: 33204 - DNA, 23 bp, Homo sapiens
ctgctggtgatggtggctgtgtg

SEQ ID NO: 33205 - DNA, 23 bp, Homo sapiens
agtggagaaggtggtgctgctca

SEQ ID NO: 33206 - DNA, 23 bp, Homo sapiens
tctcgacggttatcctgatggcc

SEQ ID NO: 33207 - DNA, 24 bp, Homo sapiens
tttgcttgtagaaaataattcttt

SEQ ID NO: 33208 - DNA, 24 bp, Homo sapiens
ctttgcttgtagaaaataattctt

SEQ ID NO: 33209 - DNA, 24 bp, Homo sapiens
tctttgcttgtagaaaataattct

SEQ ID NO: 33210 - DNA, 24 bp, Homo sapiens
gacagaagtgacggaagagacggt

SEQ ID NO: 33211 - DNA, 24 bp, Homo sapiens
acaatgagatgcgggtcacagagt

SEQ ID NO: 33212 - DNA, 24 bp, Homo sapiens
gagctggagcctggtgtggagtac

SEQ ID NO: 33213 - DNA, 23 bp, Homo sapiens
cttctcagggctggcagtcatcg

SEQ ID NO: 33214 - DNA, 23 bp, Homo sapiens
ggcactggtacaggcacagcacc

SEQ ID NO: 33215 - DNA, 24 bp, Homo sapiens
ggcttctatggcttccctgactgc

SEQ ID NO: 33216 - DNA, 24 bp, Homo sapiens
ctaccactcagagaagaattgatt

SEQ ID NO: 33217 - DNA, 24 bp, Homo sapiens
tctaccactcagagaagaattgat

SEQ ID NO: 33218 - DNA, 24 bp, Homo sapiens
ctctaccactcagagaagaattga

SEQ ID NO: 33219 - DNA, 24 bp, Homo sapiens
ttcccataaaggtttgaaatttta

SEQ ID NO: 33220 - DNA, 24 bp, Homo sapiens
attcccataaaggtttgaaatttt

SEQ ID NO: 33221 - DNA, 24 bp, Homo sapiens
tattcccataaaggtttgaaattt

SEQ ID NO: 33222 - DNA, 24 bp, Homo sapiens
aaaaaacacagttgaagggatctg

SEQ ID NO: 33223 - DNA, 24 bp, Homo sapiens
gaaaaaacacagttgaagggatct

SEQ ID NO: 33224 - DNA, 24 bp, Homo sapiens
agaaaaaacacagttgaagggatc

SEQ ID NO: 33225 - DNA, 23 bp, Homo sapiens
ctcctcctgcctcactgccagaa

SEQ ID NO: 33226 - DNA, 24 bp, Homo sapiens
gaccttcacgcagtcaagaacgac

SEQ ID NO: 33227 - DNA, 23 bp, Homo sapiens
gtccccagtgccctctccctcct

SEQ ID NO: 33228 - DNA, 24 bp, Homo sapiens
aattaatagttgtaagtatgagtc

SEQ ID NO: 33229 - DNA, 24 bp, Homo sapiens
aaattaatagttgtaagtatgagt

SEQ ID NO: 33230 - DNA, 24 bp, Homo sapiens
caaattaatagttgtaagtatgag

SEQ ID NO: 33231 - DNA, 24 bp, Homo sapiens
agcgttcaccgatctccatctgcg

SEQ ID NO: 33232 - DNA, 24 bp, Homo sapiens
gcatctccacctcagcagcctccc

SEQ ID NO: 33233 - DNA, 24 bp, Homo sapiens
tggatatggatgaagatgacgact

SEQ ID NO: 33234 - DNA, 23 bp, Homo sapiens
taccacgcagccaacagcaagaa

SEQ ID NO: 33235 - DNA, 24 bp, Homo sapiens
cgacatgctggactacctgctgag

SEQ ID NO: 33236 - DNA, 23 bp, Homo sapiens
cagatcagccggcgagatgcctt

SEQ ID NO: 33237 - DNA, 24 bp, Homo sapiens
ggacacaaatgctgtttcattcaa

SEQ ID NO: 33238 - DNA, 24 bp, Homo sapiens
aggacacaaatgctgtttcattca

SEQ ID NO: 33239 - DNA, 24 bp, Homo sapiens
caggacacaaatgctgtttcattc

SEQ ID NO: 33240 - DNA, 25 bp, Homo sapiens
cgactggattgccttggatgctgat

SEQ ID NO: 33241 - DNA, 23 bp, Homo sapiens
gacatcgccgcagcactcatcgc

SEQ ID NO: 33242 - DNA, 25 bp, Homo sapiens
cctgtaaggacattgctgctgttct

SEQ ID NO: 33243 - DNA, 25 bp, Homo sapiens
gtcttgggtgatggtggagtaaagc

SEQ ID NO: 33244 - DNA, 25 bp, Homo sapiens
gctgtgagtatctttctttggctct

SEQ ID NO: 33245 - DNA, 25 bp, Homo sapiens
gtgatgccctgcaacatgcacaatg

SEQ ID NO: 33246 - DNA, 23 bp, Homo sapiens
ccgcatcccaggaggctgtttaa

SEQ ID NO: 33247 - DNA, 24 bp, Homo sapiens
ggacatattacagcaggaactggc

SEQ ID NO: 33248 - DNA, 23 bp, Homo sapiens
caaagtgctgggattacagggag

SEQ ID NO: 33249 - DNA, 24 bp, Homo sapiens
aaattttacagatcacaaaggcat

SEQ ID NO: 33250 - DNA, 24 bp, Homo sapiens
aaaattttacagatcacaaaggca

SEQ ID NO: 33251 - DNA, 24 bp, Homo sapiens
caaaattttacagatcacaaaggc

SEQ ID NO: 33252 - DNA, 23 bp, Homo sapiens
ctgcgtcttcttccgagtcgtcc

SEQ ID NO: 33253 - DNA, 23 bp, Homo sapiens
agcggcagcgtcaccatcctcac

SEQ ID NO: 33254 - DNA, 24 bp, Homo sapiens
gttgcctgccacctgctcttctac

SEQ ID NO: 33255 - DNA, 24 bp, Homo sapiens
tagaaaactggctttttggattgg

SEQ ID NO: 33256 - DNA, 24 bp, Homo sapiens
ttagaaaactggctttttggattg

SEQ ID NO: 33257 - DNA, 24 bp, Homo sapiens
tttagaaaactggctttttggatt

SEQ ID NO: 33258 - DNA, 24 bp, Homo sapiens
cgcaatggctcacacctgtaatcc

SEQ ID NO: 33259 - DNA, 25 bp, Homo sapiens
gtagattcgccacaaccaagtctga

SEQ ID NO: 33260 - DNA, 25 bp, Homo sapiens
gttctggtactagacaagagcagcc

SEQ ID NO: 33261 - DNA, 24 bp, Homo sapiens
aagtatccagggtatgaacatact

SEQ ID NO: 33262 - DNA, 24 bp, Homo sapiens
gaagtatccagggtatgaacatac

SEQ ID NO: 33263 - DNA, 24 bp, Homo sapiens
agaagtatccagggtatgaacata

SEQ ID NO: 33264 - DNA, 25 bp, Homo sapiens
aatagtggtggtggttccagctaga

SEQ ID NO: 33265 - DNA, 24 bp, Homo sapiens
gcttctgctgttaccaatgcctca

SEQ ID NO: 33266 - DNA, 25 bp, Homo sapiens
agataacggaagtgaggaagggtga

SEQ ID NO: 33267 - DNA, 24 bp, Homo sapiens
ccgtgggcaatagcagtcagagtg

SEQ ID NO: 33268 - DNA, 24 bp, Homo sapiens
cggcacttcaggattcatgctgca

SEQ ID NO: 33269 - DNA, 24 bp, Homo sapiens
cacaccacctgcccagctcctctg

SEQ ID NO: 33270 - DNA, 24 bp, Homo sapiens
ttcatcatgctgagctgcgagtgg

SEQ ID NO: 33271 - DNA, 24 bp, Homo sapiens
cacgctgggctggcttgacgaaca

SEQ ID NO: 33272 - DNA, 24 bp, Homo sapiens
ctcctcgatggccgttcacctcct

SEQ ID NO: 33273 - DNA, 24 bp, Homo sapiens
ccgtgggcaatagcagtcagagtg

SEQ ID NO: 33274 - DNA, 24 bp, Homo sapiens
cacgctgggctggcttgacgaaca

SEQ ID NO: 33275 - DNA, 24 bp, Homo sapiens
ttcatcatgctgagctgcgagtgg

SEQ ID NO: 33276 - DNA, 24 bp, Homo sapiens
cccacaccggggtgagccggggct

SEQ ID NO: 33277 - DNA, 24 bp, Homo sapiens
tcccacaccggggtgagccggggc

SEQ ID NO: 33278 - DNA, 24 bp, Homo sapiens
ctcccacaccggggtgagccgggg

SEQ ID NO: 33279 - DNA, 24 bp, Homo sapiens
cagaaatagtggctcttataatga

SEQ ID NO: 33280 - DNA, 24 bp, Homo sapiens
tcagaaatagtggctcttataatg

SEQ ID NO: 33281 - DNA, 24 bp, Homo sapiens
ttcagaaatagtggctcttataat

SEQ ID NO: 33282 - DNA, 23 bp, Homo sapiens
ctgctgctgctgctgctgctgag

SEQ ID NO: 33283 - DNA, 25 bp, Homo sapiens
ggtgaagaagatccgtaagcagatg

SEQ ID NO: 33284 - DNA, 23 bp, Homo sapiens
gtggctcacctacgtgcacctgg

SEQ ID NO: 33285 - DNA, 24 bp, Homo sapiens
catttaaagatgtaagttttataa

SEQ ID NO: 33286 - DNA, 24 bp, Homo sapiens
gcatttaaagatgtaagttttata

SEQ ID NO: 33287 - DNA, 24 bp, Homo sapiens
agcatttaaagatgtaagttttat

SEQ ID NO: 33288 - DNA, 24 bp, Homo sapiens
acttataaaagttaaacattagat

SEQ ID NO: 33289 - DNA, 24 bp, Homo sapiens
gacttataaaagttaaacattaga

SEQ ID NO: 33290 - DNA, 24 bp, Homo sapiens
agacttataaaagttaaacattag

SEQ ID NO: 33291 - DNA, 23 bp, Homo sapiens
gttgccacgacgacgaagctgcc

SEQ ID NO: 33292 - DNA, 23 bp, Homo sapiens
gagttcgtgcagcagtacgcctt

SEQ ID NO: 33293 - DNA, 23 bp, Homo sapiens
cgctggcggctgtggctctaccc

SEQ ID NO: 33294 - DNA, 24 bp, Homo sapiens
tggcttccttcaagttggctgact

SEQ ID NO: 33295 - DNA, 24 bp, Homo sapiens
cagcaagaggcagaggaaccaagg

SEQ ID NO: 33296 - DNA, 24 bp, Homo sapiens
gcctgtgctcgtgctgtctcttac

SEQ ID NO: 33297 - DNA, 24 bp, Homo sapiens
gaggttgcagtgagctgagatcgc

SEQ ID NO: 33298 - DNA, 24 bp, Homo sapiens
gccagtgtcaacacatggaccaca

SEQ ID NO: 33299 - DNA, 24 bp, Homo sapiens
aacatgggaaagaccagccttggc

SEQ ID NO: 33300 - DNA, 24 bp, Homo sapiens
gaggttgcagtgagctgagatcgc

SEQ ID NO: 33301 - DNA, 24 bp, Homo sapiens
aacatgggaaagaccagccttggc

SEQ ID NO: 33302 - DNA, 24 bp, Homo sapiens
aactctgtcagattgctgcaaaca

SEQ ID NO: 33303 - DNA, 24 bp, Homo sapiens
gagtgggagtgcctggacgctgtg

SEQ ID NO: 33304 - DNA, 24 bp, Homo sapiens
agggatgtgtccatagacctctcc

SEQ ID NO: 33305 - DNA, 24 bp, Homo sapiens
tggaggaaactcaaggagaactga

SEQ ID NO: 33306 - DNA, 24 bp, Homo sapiens
tgggatcttgccatgttgttcagg

SEQ ID NO: 33307 - DNA, 24 bp, Homo sapiens
gcctcctgagtacatattccctgg

SEQ ID NO: 33308 - DNA, 24 bp, Homo sapiens
ggttcaagaatactggacatctgg

SEQ ID NO: 33309 - DNA, 24 bp, Homo sapiens
aagatatacaggtatgaagcaaag

SEQ ID NO: 33310 - DNA, 24 bp, Homo sapiens
caagatatacaggtatgaagcaaa

SEQ ID NO: 33311 - DNA, 24 bp, Homo sapiens
acaagatatacaggtatgaagcaa

SEQ ID NO: 33312 - DNA, 23 bp, Homo sapiens
acgtgtccgaatgaccaggtggt

SEQ ID NO: 33313 - DNA, 23 bp, Homo sapiens
agacgcctctgcctgcctgacat

SEQ ID NO: 33314 - DNA, 23 bp, Homo sapiens
caagcctgaagtcgccgagtcca

SEQ ID NO: 33315 - DNA, 24 bp, Homo sapiens
agtgacgaccttaccaagccaatc

SEQ ID NO: 33316 - DNA, 24 bp, Homo sapiens
aagttcttctgcgagaccatcctg

SEQ ID NO: 33317 - DNA, 24 bp, Homo sapiens
tccaggtctccttccagcatccac

SEQ ID NO: 33318 - DNA, 24 bp, Homo sapiens
actcagactggcttccttgctcct

SEQ ID NO: 33319 - DNA, 24 bp, Homo sapiens
gatgcctactggaagcctgttctt

SEQ ID NO: 33320 - DNA, 24 bp, Homo sapiens
actcacattacagcccaggactca

SEQ ID NO: 33321 - DNA, 24 bp, Homo sapiens
aaggagcaggcagcaattagcagg

SEQ ID NO: 33322 - DNA, 25 bp, Homo sapiens
acgcttgaccacctcgcttagaatc

SEQ ID NO: 33323 - DNA, 25 bp, Homo sapiens
gcttctcaggtccattggcatcttc

SEQ ID NO: 33324 - DNA, 24 bp, Homo sapiens
aaggagcaggcagcaattagcagg

SEQ ID NO: 33325 - DNA, 24 bp, Homo sapiens
ctggcaaagtcgcaaggagtcaca

SEQ ID NO: 33326 - DNA, 25 bp, Homo sapiens
cattgaaaccaaccaaggcaagact

SEQ ID NO: 33327 - DNA, 24 bp, Homo sapiens
tggacaagctctaccccgaatctc

SEQ ID NO: 33328 - DNA, 24 bp, Homo sapiens
acggcactgagttcaagagcatct

SEQ ID NO: 33329 - DNA, 24 bp, Homo sapiens
gagtctggctgctcccaccgcccg

SEQ ID NO: 33330 - DNA, 24 bp, Homo sapiens
aacaagaaaagtgctgaaatcaag

SEQ ID NO: 33331 - DNA, 24 bp, Homo sapiens
caacaagaaaagtgctgaaatcaa

SEQ ID NO: 33332 - DNA, 24 bp, Homo sapiens
gcaacaagaaaagtgctgaaatca

SEQ ID NO: 33333 - DNA, 24 bp, Homo sapiens
atttggaacagtatgaaaatgagg

SEQ ID NO: 33334 - DNA, 24 bp, Homo sapiens
aatttggaacagtatgaaaatgag

SEQ ID NO: 33335 - DNA, 24 bp, Homo sapiens
taatttggaacagtatgaaaatga

SEQ ID NO: 33336 - DNA, 24 bp, Homo sapiens
ctcaaaaataaggagaataagagt

SEQ ID NO: 33337 - DNA, 24 bp, Homo sapiens
tctcaaaaataaggagaataagag

SEQ ID NO: 33338 - DNA, 24 bp, Homo sapiens
gtctcaaaaataaggagaataaga

SEQ ID NO: 33339 - DNA, 25 bp, Homo sapiens
ggctgctcacaaacattctctccct

SEQ ID NO: 33340 - DNA, 25 bp, Homo sapiens
aacaacatcaaggacctggaggact

SEQ ID NO: 33341 - DNA, 25 bp, Homo sapiens
atagtggcggtcatcaaggcagaac

SEQ ID NO: 33342 - DNA, 23 bp, Homo sapiens
cagtgcgagccttggcgatggag

SEQ ID NO: 33343 - DNA, 24 bp, Homo sapiens
ttgtcggagaaagaatgggagcgg

SEQ ID NO: 33344 - DNA, 24 bp, Homo sapiens
gccgtgagcctccatctctatctc

SEQ ID NO: 33345 - DNA, 24 bp, Homo sapiens
aagtccaagatcatggcactggca

SEQ ID NO: 33346 - DNA, 24 bp, Homo sapiens
gccacgtactgtgtcaagacatgg

SEQ ID NO: 33347 - DNA, 24 bp, Homo sapiens
ccgagttgctggaatagttggtgt

SEQ ID NO: 33348 - DNA, 24 bp, Homo sapiens
tccatccaccagcacagccagttc

SEQ ID NO: 33349 - DNA, 24 bp, Homo sapiens
gcgagaatatccttcctgctgctc

SEQ ID NO: 33350 - DNA, 24 bp, Homo sapiens
aaggcatcgcaagtttccagctcc

SEQ ID NO: 33351 - DNA, 24 bp, Homo sapiens
cccacccattcaagtccacatccc

SEQ ID NO: 33352 - DNA, 24 bp, Homo sapiens
gagcaattctcccacctcagccta

SEQ ID NO: 33353 - DNA, 24 bp, Homo sapiens
tgcccaggctggacttgaacttct

SEQ ID NO: 33354 - DNA, 24 bp, Homo sapiens
gttcaaacgatcctcccgcctcag

SEQ ID NO: 33355 - DNA, 23 bp, Homo sapiens
gtctcattctgtcgcccaggctg

SEQ ID NO: 33356 - DNA, 25 bp, Homo sapiens
tttccttcatctccaaagtcctcta

SEQ ID NO: 33357 - DNA, 25 bp, Homo sapiens
gcctccttgttctggtcatacacag

SEQ ID NO: 33358 - DNA, 25 bp, Homo sapiens
tgctcagaccacccaagtatcatct

SEQ ID NO: 33359 - DNA, 24 bp, Homo sapiens
gttcaaacgatcctcccgcctcag

SEQ ID NO: 33360 - DNA, 24 bp, Homo sapiens
gttatcaatcggtgagtttttact

SEQ ID NO: 33361 - DNA, 24 bp, Homo sapiens
tgttatcaatcggtgagtttttac

SEQ ID NO: 33362 - DNA, 24 bp, Homo sapiens
atgttatcaatcggtgagttttta

SEQ ID NO: 33363 - DNA, 24 bp, Homo sapiens
ttgccttctgccatgattgtgagt

SEQ ID NO: 33364 - DNA, 24 bp, Homo sapiens
aacaatcttccttgatgacccagc

SEQ ID NO: 33365 - DNA, 24 bp, Homo sapiens
cctccacagccatgcttcctgtac

SEQ ID NO: 33366 - DNA, 24 bp, Homo sapiens
aacaatcttccttgatgacccagc

SEQ ID NO: 33367 - DNA, 24 bp, Homo sapiens
ttgccttctgccatgattgtgagt

SEQ ID NO: 33368 - DNA, 24 bp, Homo sapiens
cgccatgtgaagaagatgcttgct

SEQ ID NO: 33369 - DNA, 24 bp, Homo sapiens
ttgccttctgccatgattgtgagt

SEQ ID NO: 33370 - DNA, 24 bp, Homo sapiens
aacaatcttccttgatgacccagc

SEQ ID NO: 33371 - DNA, 24 bp, Homo sapiens
ggaggaatgaaagcaagtgaagga

SEQ ID NO: 33372 - DNA, 24 bp, Homo sapiens
ttgccttctgccatgattgtgagt

SEQ ID NO: 33373 - DNA, 24 bp, Homo sapiens
cgccatgtgaagaagatgcttgct

SEQ ID NO: 33374 - DNA, 24 bp, Homo sapiens
ccagaagacagtcacagtagtcca

SEQ ID NO: 33375 - DNA, 25 bp, Homo sapiens
aacaccaccaccaacagacaaacca

SEQ ID NO: 33376 - DNA, 25 bp, Homo sapiens
gctgtcactattggctctgtagatt

SEQ ID NO: 33377 - DNA, 25 bp, Homo sapiens
gcctgtagcatcccttattattcca

SEQ ID NO: 33378 - DNA, 23 bp, Homo sapiens
ccgctcaacgagaaccagacagg

SEQ ID NO: 33379 - DNA, 25 bp, Homo sapiens
cgctcaacatctccacgtccatcag

SEQ ID NO: 33380 - DNA, 23 bp, Homo sapiens
agtggtggatgctgctgtgcctg

SEQ ID NO: 33381 - DNA, 23 bp, Homo sapiens
ccgctcaacgagaaccagacagg

SEQ ID NO: 33382 - DNA, 23 bp, Homo sapiens
agtggtggatgctgctgtgcctg

SEQ ID NO: 33383 - DNA, 25 bp, Homo sapiens
tcgtcctgaccatcttcctcatccg

SEQ ID NO: 33384 - DNA, 23 bp, Homo sapiens
agtggtggatgctgctgtgcctg

SEQ ID NO: 33385 - DNA, 25 bp, Homo sapiens
ctcaacatctccacgtccatcagcg

SEQ ID NO: 33386 - DNA, 24 bp, Homo sapiens
gctcccctgtggactacttctggt

SEQ ID NO: 33387 - DNA, 23 bp, Homo sapiens
agtggtggatgctgctgtgcctg

SEQ ID NO: 33388 - DNA, 23 bp, Homo sapiens
ccgctcaacgagaaccagacagg

SEQ ID NO: 33389 - DNA, 23 bp, Homo sapiens
gctgtacctggagttcgccatcg

SEQ ID NO: 33390 - DNA, 25 bp, Homo sapiens
gccctgttgctgctgtccatctatt

SEQ ID NO: 33391 - DNA, 24 bp, Homo sapiens
cccttcacttggatgcttgccctc

SEQ ID NO: 33392 - DNA, 23 bp, Homo sapiens
tcgcaggcactgaacatcctcct

SEQ ID NO: 33393 - DNA, 25 bp, Homo sapiens
cctgtgatgacctggtagtcttagc

SEQ ID NO: 33394 - DNA, 25 bp, Homo sapiens
aacttgaactggagtgcctctgctg

SEQ ID NO: 33395 - DNA, 25 bp, Homo sapiens
ggtggtggtgatgttgggaagatgt

SEQ ID NO: 33396 - DNA, 24 bp, Homo sapiens
ctcaccaggggctcactttctcca

SEQ ID NO: 33397 - DNA, 24 bp, Homo sapiens
gctgctgctgctgttccttctctt

SEQ ID NO: 33398 - DNA, 24 bp, Homo sapiens
gcaggatatttcgctggaccctag

SEQ ID NO: 33399 - DNA, 24 bp, Homo sapiens
tctcactctagatcctagatgttt

SEQ ID NO: 33400 - DNA, 24 bp, Homo sapiens
ttctcactctagatcctagatgtt

SEQ ID NO: 33401 - DNA, 24 bp, Homo sapiens
ttctcactctagatcctagatgtt

SEQ ID NO: 33402 - DNA, 25 bp, Homo sapiens
ggttcagtggctgtaatggctcagg

SEQ ID NO: 33403 - DNA, 25 bp, Homo sapiens
atctgcctgccactacctcatctga

SEQ ID NO: 33404 - DNA, 25 bp, Homo sapiens
caccagagaccaggatgaagatgat

SEQ ID NO: 33405 - DNA, 25 bp, Homo sapiens
agcactcacggaagaaggagatgga

SEQ ID NO: 33406 - DNA, 25 bp, Homo sapiens
ccttcctgtgtccatgtgttctcat

SEQ ID NO: 33407 - DNA, 25 bp, Homo sapiens
ccacctatgagtgagaacatgcggt

SEQ ID NO: 33408 - DNA, 24 bp, Homo sapiens
ccgctcctgctcctgctgctgtcg

SEQ ID NO: 33409 - DNA, 24 bp, Homo sapiens
atgagcggcgccctgctctggccg

SEQ ID NO: 33410 - DNA, 24 bp, Homo sapiens
tgttatatcaggtcagtgataagt

SEQ ID NO: 33411 - DNA, 24 bp, Homo sapiens
atgttatatcaggtcagtgataag

SEQ ID NO: 33412 - DNA, 24 bp, Homo sapiens
catgttatatcaggtcagtgataa

SEQ ID NO: 33413 - DNA, 24 bp, Homo sapiens
ttgcttttcagggattattttacg

SEQ ID NO: 33414 - DNA, 24 bp, Homo sapiens
tttgcttttcagggattattttac

SEQ ID NO: 33415 - DNA, 24 bp, Homo sapiens
gtttgcttttcagggattatttta

SEQ ID NO: 33416 - DNA, 24 bp, Homo sapiens
atgcaatacatgtgagttatatta

SEQ ID NO: 33417 - DNA, 24 bp, Homo sapiens
catgcaatacatgtgagttatatt

SEQ ID NO: 33418 - DNA, 24 bp, Homo sapiens
acatgcaatacatgtgagttatat

SEQ ID NO: 33419 - DNA, 25 bp, Homo sapiens
agggatggattgtaaacttgtgggc

SEQ ID NO: 33420 - DNA, 25 bp, Homo sapiens
cggagaattgttggtgaggatgatg

SEQ ID NO: 33421 - DNA, 23 bp, Homo sapiens
caatggagcggttgacgttgcct

SEQ ID NO: 33422 - DNA, 24 bp, Homo sapiens
cactgggactctcacctgtgcttc

SEQ ID NO: 33423 - DNA, 24 bp, Homo sapiens
agaggagaaccaagctgtgacagg

SEQ ID NO: 33424 - DNA, 24 bp, Homo sapiens
tcctcacagggctccttctgacac

SEQ ID NO: 33425 - DNA, 24 bp, Homo sapiens
gtgatggtggctgtgggtgtctac

SEQ ID NO: 33426 - DNA, 25 bp, Homo sapiens
ctgctcttcttcttcaacatgctct

SEQ ID NO: 33427 - DNA, 24 bp, Homo sapiens
ccacatcactggcctgtgctgctg

SEQ ID NO: 33428 - DNA, 24 bp, Homo sapiens
accacatcactggcctgtgctgct

SEQ ID NO: 33429 - DNA, 24 bp, Homo sapiens
gaccacatcactggcctgtgctgc

SEQ ID NO: 33430 - DNA, 24 bp, Homo sapiens
ttcttttacagctagttatgtatc

SEQ ID NO: 33431 - DNA, 24 bp, Homo sapiens
tttcttttacagctagttatgtat

SEQ ID NO: 33432 - DNA, 24 bp, Homo sapiens
ttttcttttacagctagttatgta

SEQ ID NO: 33433 - DNA, 23 bp, Homo sapiens
ctgactgatggtgctgctgctgg

SEQ ID NO: 33434 - DNA, 25 bp, Homo sapiens
tccacaaagaaagagcagaaagcat

SEQ ID NO: 33435 - DNA, 25 bp, Homo sapiens
acagagattgaagagtatcacaggc

SEQ ID NO: 33436 - DNA, 24 bp, Homo sapiens
gagctaaagaggtgtgacaacatg

SEQ ID NO: 33437 - DNA, 24 bp, Homo sapiens
agagctaaagaggtgtgacaacat

SEQ ID NO: 33438 - DNA, 24 bp, Homo sapiens
cagagctaaagaggtgtgacaaca

SEQ ID NO: 33439 - DNA, 24 bp, Homo sapiens
agaggctgaagatagagtgggaag

SEQ ID NO: 33440 - DNA, 24 bp, Homo sapiens
gagaggctgaagatagagtgggaa

SEQ ID NO: 33441 - DNA, 24 bp, Homo sapiens
agagaggctgaagatagagtggga

SEQ ID NO: 33442 - DNA, 24 bp, Homo sapiens
tcagataagtaaaataattcatgc

SEQ ID NO: 33443 - DNA, 24 bp, Homo sapiens
ctaaagtaaaaaagctacagaagc

SEQ ID NO: 33444 - DNA, 24 bp, Homo sapiens
tctttctgtaggctgttgcaacct

SEQ ID NO: 33445 - DNA, 24 bp, Homo sapiens
ttctttctgtaggctgttgcaacc

SEQ ID NO: 33446 - DNA, 24 bp, Homo sapiens
tttctttctgtaggctgttgcaac

SEQ ID NO: 33447 - DNA, 25 bp, Homo sapiens
cctcaccagtctcatcctgacaatc

SEQ ID NO: 33448 - DNA, 25 bp, Homo sapiens
gtgggagacagagagacagcagaca

SEQ ID NO: 33449 - DNA, 24 bp, Homo sapiens
aaccacctttccagagagcatcag

SEQ ID NO: 33450 - DNA, 24 bp, Homo sapiens
cagtgcgaggacttacacctggat

SEQ ID NO: 33451 - DNA, 24 bp, Homo sapiens
atacgcacacaggcacacccactc

SEQ ID NO: 33452 - DNA, 24 bp, Homo sapiens
cctgggagaaagtgctgtcgtcgg

SEQ ID NO: 33453 - DNA, 24 bp, Homo sapiens
agacatttaagattatttttgaag

SEQ ID NO: 33454 - DNA, 24 bp, Homo sapiens
aagacatttaagattatttttgaa

SEQ ID NO: 33455 - DNA, 24 bp, Homo sapiens
gaagacatttaagattatttttga

SEQ ID NO: 33456 - DNA, 24 bp, Homo sapiens
ccttcctaaagattatttttgaag

SEQ ID NO: 33457 - DNA, 24 bp, Homo sapiens
tccttcctaaagattatttttgaa

SEQ ID NO: 33458 - DNA, 24 bp, Homo sapiens
ttccttcctaaagattatttttga

SEQ ID NO: 33459 - DNA, 24 bp, Homo sapiens
ataataataaggaagaagaaatat

SEQ ID NO: 33460 - DNA, 24 bp, Homo sapiens
tataataataaggaagaagaaata

SEQ ID NO: 33461 - DNA, 24 bp, Homo sapiens
gtataataataaggaagaagaaat

SEQ ID NO: 33462 - DNA, 24 bp, Homo sapiens
ataataataagctttttcaatttt

SEQ ID NO: 33463 - DNA, 24 bp, Homo sapiens
tataataataagctttttcaattt

SEQ ID NO: 33464 - DNA, 24 bp, Homo sapiens
gtataataataagctttttcaatt

SEQ ID NO: 33465 - DNA, 24 bp, Homo sapiens
ctccagacgaggtcggttcctgtg

SEQ ID NO: 33466 - DNA, 24 bp, Homo sapiens
gcttcacttgctcctttctggtcc

SEQ ID NO: 33467 - DNA, 24 bp, Homo sapiens
tgccgcagcaccacctacacttgc

SEQ ID NO: 33468 - DNA, 24 bp, Homo sapiens
ggagtgtgcctgccggtgctcaat

SEQ ID NO: 33469 - DNA, 24 bp, Homo sapiens
gggagtgtgcctgccggtgctcaa

SEQ ID NO: 33470 - DNA, 24 bp, Homo sapiens
tgggagtgtgcctgccggtgctca

SEQ ID NO: 33471 - DNA, 24 bp, Homo sapiens
gtttcttccagagagtttatgtca

SEQ ID NO: 33472 - DNA, 24 bp, Homo sapiens
tgtttcttccagagagtttatgtc

SEQ ID NO: 33473 - DNA, 24 bp, Homo sapiens
ttgtttcttccagagagtttatgt

SEQ ID NO: 33474 - DNA, 24 bp, Homo sapiens
gaaaactgccagaaatcagagtcg

SEQ ID NO: 33475 - DNA, 24 bp, Homo sapiens
tgaaaactgccagaaatcagagtc

SEQ ID NO: 33476 - DNA, 24 bp, Homo sapiens
ttgaaaactgccagaaatcagagt

SEQ ID NO: 33477 - DNA, 24 bp, Homo sapiens
gacaaaaccaggagaagtaaaaac

SEQ ID NO: 33478 - DNA, 24 bp, Homo sapiens
tgacaaaaccaggagaagtaaaaa

SEQ ID NO: 33479 - DNA, 24 bp, Homo sapiens
atgacaaaaccaggagaagtaaaa

SEQ ID NO: 33480 - DNA, 24 bp, Homo sapiens
accttttaaagccattaatggaaa

SEQ ID NO: 33481 - DNA, 24 bp, Homo sapiens
caccttttaaagccattaatggaa

SEQ ID NO: 33482 - DNA, 24 bp, Homo sapiens
tcaccttttaaagccattaatgga

SEQ ID NO: 33483 - DNA, 24 bp, Homo sapiens
agattcagaaggtaaatatcaatc

SEQ ID NO: 33484 - DNA, 24 bp, Homo sapiens
aagattcagaaggtaaatatcaat

SEQ ID NO: 33485 - DNA, 24 bp, Homo sapiens
aaagattcagaaggtaaatatcaa

SEQ ID NO: 33486 - DNA, 24 bp, Homo sapiens
agtgctttttagtaaggtctgtgg

SEQ ID NO: 33487 - DNA, 24 bp, Homo sapiens
gagtgctttttagtaaggtctgtg

SEQ ID NO: 33488 - DNA, 24 bp, Homo sapiens
ggagtgctttttagtaaggtctgt

SEQ ID NO: 33489 - DNA, 24 bp, Homo sapiens
gctggttgtgctggaggttcagtt

SEQ ID NO: 33490 - DNA, 25 bp, Homo sapiens
tgtagaagaggtggtggaatctgga

SEQ ID NO: 33491 - DNA, 23 bp, Homo sapiens
gctgtgtgctggcttccctgatt

SEQ ID NO: 33492 - DNA, 24 bp, Homo sapiens
ccttcaccattgctggcagagacc

SEQ ID NO: 33493 - DNA, 23 bp, Homo sapiens
agacagtggcagtggctttgagc

SEQ ID NO: 33494 - DNA, 23 bp, Homo sapiens
gccatggttccatttgtttctga

SEQ ID NO: 33495 - DNA, 24 bp, Homo sapiens
gaatattgcattattatcccctag

SEQ ID NO: 33496 - DNA, 24 bp, Homo sapiens
ggaatattgcattattatccccta

SEQ ID NO: 33497 - DNA, 24 bp, Homo sapiens
aggaatattgcattattatcccct

SEQ ID NO: 33498 - DNA, 24 bp, Homo sapiens
tgtgcacataggtaacaaatatac

SEQ ID NO: 33499 - DNA, 24 bp, Homo sapiens
atgtgcacataggtaacaaatata

SEQ ID NO: 33500 - DNA, 24 bp, Homo sapiens
gatgtgcacataggtaacaaatat

SEQ ID NO: 33501 - DNA, 24 bp, Homo sapiens
tacatttgtagaaattgagtttaa

SEQ ID NO: 33502 - DNA, 24 bp, Homo sapiens
ttacatttgtagaaattgagttta

SEQ ID NO: 33503 - DNA, 24 bp, Homo sapiens
gttacatttgtagaaattgagttt

SEQ ID NO: 33504 - DNA, 24 bp, Homo sapiens
cagatggacaggtcctaaacctag

SEQ ID NO: 33505 - DNA, 24 bp, Homo sapiens
acagatggacaggtcctaaaccta

SEQ ID NO: 33506 - DNA, 24 bp, Homo sapiens
aacagatggacaggtcctaaacct

SEQ ID NO: 33507 - DNA, 24 bp, Homo sapiens
tgaagaagagtaacctgcctgtcc

SEQ ID NO: 33508 - DNA, 24 bp, Homo sapiens
gcaatggcacgatcttggctcacc

SEQ ID NO: 33509 - DNA, 24 bp, Homo sapiens
tgcatctgagggagaagcacctgt

SEQ ID NO: 33510 - DNA, 24 bp, Homo sapiens
gttttcttcagataaaaatgatag

SEQ ID NO: 33511 - DNA, 24 bp, Homo sapiens
tgttttcttcagataaaaatgata

SEQ ID NO: 33512 - DNA, 24 bp, Homo sapiens
ttgttttcttcagataaaaatgat

SEQ ID NO: 33513 - DNA, 24 bp, Homo sapiens
cgtccatcttctgccgagccaaat

SEQ ID NO: 33514 - DNA, 24 bp, Homo sapiens
gaagagtaacctgcctgtccatca

SEQ ID NO: 33515 - DNA, 24 bp, Homo sapiens
ggaatttcgctcttgttgcccagg

SEQ ID NO: 33516 - DNA, 24 bp, Homo sapiens
gccgagccaaattacaaccagaga

SEQ ID NO: 33517 - DNA, 24 bp, Homo sapiens
gaagagtaacctgcctgtccatca

SEQ ID NO: 33518 - DNA, 24 bp, Homo sapiens
caatggcacgatcttggctcaccg

SEQ ID NO: 33519 - DNA, 24 bp, Homo sapiens
caatggcacgatcttggctcaccg

SEQ ID NO: 33520 - DNA, 24 bp, Homo sapiens
aggcttcagaacacaaaggaaagt

SEQ ID NO: 33521 - DNA, 24 bp, Homo sapiens
tgtgcttagcgtcagtcgtcagga

SEQ ID NO: 33522 - DNA, 24 bp, Homo sapiens
gcaatggcacgatcttggctcacc

SEQ ID NO: 33523 - DNA, 24 bp, Homo sapiens
gaagagtaacctgcctgtccatca

SEQ ID NO: 33524 - DNA, 24 bp, Homo sapiens
cgtccatcttctgccgagccaaat

SEQ ID NO: 33525 - DNA, 24 bp, Homo sapiens
caatggcacgatcttggctcaccg

SEQ ID NO: 33526 - DNA, 24 bp, Homo sapiens
gaagagtaacctgcctgtccatca

SEQ ID NO: 33527 - DNA, 24 bp, Homo sapiens
acgccaacagtaccacaatgacat

SEQ ID NO: 33528 - DNA, 24 bp, Homo sapiens
ccgtggtggagatggatggtgatg

SEQ ID NO: 33529 - DNA, 24 bp, Homo sapiens
accgtgaccagactgatgaccagg

SEQ ID NO: 33530 - DNA, 24 bp, Homo sapiens
tctggcagttcatcaaggagaagc

SEQ ID NO: 33531 - DNA, 24 bp, Homo sapiens
ccctgacagcccccacctcgcaag

SEQ ID NO: 33532 - DNA, 24 bp, Homo sapiens
tacctgcgggtcgtgcgctcgctc

SEQ ID NO: 33533 - DNA, 24 bp, Homo sapiens
cctgctcgttcgctctccagcttg

SEQ ID NO: 33534 - DNA, 24 bp, Homo sapiens
gtttttcccagtctattattctgg

SEQ ID NO: 33535 - DNA, 24 bp, Homo sapiens
tgtttttcccagtctattattctg

SEQ ID NO: 33536 - DNA, 24 bp, Homo sapiens
atgtttttcccagtctattattct

SEQ ID NO: 33537 - DNA, 24 bp, Homo sapiens
aattttattagttatctctcttac

SEQ ID NO: 33538 - DNA, 24 bp, Homo sapiens
aaattttattagttatctctctta

SEQ ID NO: 33539 - DNA, 24 bp, Homo sapiens
taaattttattagttatctctctt

SEQ ID NO: 33540 - DNA, 24 bp, Homo sapiens
catggcaaaagttatctctcttac

SEQ ID NO: 33541 - DNA, 24 bp, Homo sapiens
ccatggcaaaagttatctctctta

SEQ ID NO: 33542 - DNA, 24 bp, Homo sapiens
tccatggcaaaagttatctctctt

SEQ ID NO: 33543 - DNA, 23 bp, Homo sapiens
caggcagtgggcaggaatatagc

SEQ ID NO: 33544 - DNA, 23 bp, Homo sapiens
atgctgctgtcggcttccaacat

SEQ ID NO: 33545 - DNA, 25 bp, Homo sapiens
tcttaatcttgagtatcactccagc

SEQ ID NO: 33546 - DNA, 24 bp, Homo sapiens
agcaaaaacctgtaggtattatta

SEQ ID NO: 33547 - DNA, 24 bp, Homo sapiens
aagcaaaaacctgtaggtattatt

SEQ ID NO: 33548 - DNA, 24 bp, Homo sapiens
aaagcaaaaacctgtaggtattat

SEQ ID NO: 33549 - DNA, 24 bp, Homo sapiens
gatggagccaggcaggcaatccat

SEQ ID NO: 33550 - DNA, 24 bp, Homo sapiens
tgatggagccaggcaggcaatcca

SEQ ID NO: 33551 - DNA, 24 bp, Homo sapiens
ttgatggagccaggcaggcaatcc

SEQ ID NO: 33552 - DNA, 23 bp, Homo sapiens
cggttggaacagagaaaggagcc

SEQ ID NO: 33553 - DNA, 23 bp, Homo sapiens
atggagagagcagcagcagtggg

SEQ ID NO: 33554 - DNA, 25 bp, Homo sapiens
cctggcaattctcaaagagtctcgc

SEQ ID NO: 33555 - DNA, 24 bp, Homo sapiens
atatgcagaaggtgaaggtcactg

SEQ ID NO: 33556 - DNA, 24 bp, Homo sapiens
gatatgcagaaggtgaaggtcact

SEQ ID NO: 33557 - DNA, 24 bp, Homo sapiens
agatatgcagaaggtgaaggtcac

SEQ ID NO: 33558 - DNA, 24 bp, Homo sapiens
acgacaatgccttcctgagctacc

SEQ ID NO: 33559 - DNA, 24 bp, Homo sapiens
cttccaggtcaacaacacccgccc

SEQ ID NO: 33560 - DNA, 24 bp, Homo sapiens
gaccgtcctggacagcaaccacac

SEQ ID NO: 33561 - DNA, 23 bp, Homo sapiens
acttcttccttcgctcgggctct

SEQ ID NO: 33562 - DNA, 25 bp, Homo sapiens
cctcaagaccatcctccgaagtaag

SEQ ID NO: 33563 - DNA, 23 bp, Homo sapiens
tctccgccctccaggaaaccaag

SEQ ID NO: 33564 - DNA, 24 bp, Homo sapiens
tgaaggtataagcagtaacagtca

SEQ ID NO: 33565 - DNA, 24 bp, Homo sapiens
agttactcataataagaagcaggt

SEQ ID NO: 33566 - DNA, 24 bp, Homo sapiens
tgacctcagagcagggccaggggc

SEQ ID NO: 33567 - DNA, 24 bp, Homo sapiens
ctgacctcagagcagggccagggg

SEQ ID NO: 33568 - DNA, 24 bp, Homo sapiens
gctgacctcagagcagggccaggg

SEQ ID NO: 33569 - DNA, 24 bp, Homo sapiens
gccttagccaatgagagtggtgtc

SEQ ID NO: 33570 - DNA, 24 bp, Homo sapiens
tgagccgcctgtgtccatttcctg

SEQ ID NO: 33571 - DNA, 24 bp, Homo sapiens
ggctgctgctgctgctgctcccag

SEQ ID NO: 33572 - DNA, 23 bp, Homo sapiens
gctacactggaatggacaccgcc

SEQ ID NO: 33573 - DNA, 23 bp, Homo sapiens
ccaccgccaccattgacatcctg

SEQ ID NO: 33574 - DNA, 24 bp, Homo sapiens
tgactcaggtcgctaccaactccg

SEQ ID NO: 33575 - DNA, 24 bp, Homo sapiens
ggctacgaaagaccctgctcctgg

SEQ ID NO: 33576 - DNA, 24 bp, Homo sapiens
tcaccatccacccacccaccttcc

SEQ ID NO: 33577 - DNA, 24 bp, Homo sapiens
acactgatgtcgctctacagacca

SEQ ID NO: 33578 - DNA, 25 bp, Homo sapiens
accaaagactccaaagaacaagggc

SEQ ID NO: 33579 - DNA, 24 bp, Homo sapiens
cagcaaccaccgcaactcaacatc

SEQ ID NO: 33580 - DNA, 24 bp, Homo sapiens
ccagcagcgactgaacctctacag

SEQ ID NO: 33581 - DNA, 25 bp, Homo sapiens
accaaagactccaaagaacaagggc

SEQ ID NO: 33582 - DNA, 24 bp, Homo sapiens
cagcaaccaccgcaactcaacatc

SEQ ID NO: 33583 - DNA, 23 bp, Homo sapiens
gaccatcccttgctgcggagaaa

SEQ ID NO: 33584 - DNA, 24 bp, Homo sapiens
tgtatttgcagaaaatgacacaga

SEQ ID NO: 33585 - DNA, 24 bp, Homo sapiens
ctgtatttgcagaaaatgacacag

SEQ ID NO: 33586 - DNA, 24 bp, Homo sapiens
tctgtatttgcagaaaatgacaca

SEQ ID NO: 33587 - DNA, 23 bp, Homo sapiens
gggaggacagcacaggaaagaaa

SEQ ID NO: 33588 - DNA, 23 bp, Homo sapiens
atcgccgtcgtccacaggaagta

SEQ ID NO: 33589 - DNA, 23 bp, Homo sapiens
aagtcagacgaggaatgaggtca

SEQ ID NO: 33590 - DNA, 25 bp, Homo sapiens
ccatcggtgttctgtccacatccag

SEQ ID NO: 33591 - DNA, 23 bp, Homo sapiens
aacgtcagtgccgcaaacctcaa

SEQ ID NO: 33592 - DNA, 25 bp, Homo sapiens
ctcacatcagcagcatcagccatca

SEQ ID NO: 33593 - DNA, 24 bp, Homo sapiens
gtggcctacctgcagttttcggaa

SEQ ID NO: 33594 - DNA, 24 bp, Homo sapiens
tcatagaggatgtaagtatgtaac

SEQ ID NO: 33595 - DNA, 24 bp, Homo sapiens
ttcatagaggatgtaagtatgtaa

SEQ ID NO: 33596 - DNA, 24 bp, Homo sapiens
cttcatagaggatgtaagtatgta

SEQ ID NO: 33597 - DNA, 24 bp, Homo sapiens
cttcatttcagaacagagggcttt

SEQ ID NO: 33598 - DNA, 24 bp, Homo sapiens
tcttcatttcagaacagagggctt

SEQ ID NO: 33599 - DNA, 24 bp, Homo sapiens
ttcttcatttcagaacagagggct

SEQ ID NO: 33600 - DNA, 24 bp, Homo sapiens
ttcactttctcactctgtcgccca

SEQ ID NO: 33601 - DNA, 24 bp, Homo sapiens
cttatcttcgtgtaatagccagcg

SEQ ID NO: 33602 - DNA, 24 bp, Homo sapiens
ggctatacctctacctgcgtgatt

SEQ ID NO: 33603 - DNA, 24 bp, Homo sapiens
aagtgctgggattacaggtgtgag

SEQ ID NO: 33604 - DNA, 24 bp, Homo sapiens
tgcctggcccagtactatagagct

SEQ ID NO: 33605 - DNA, 24 bp, Homo sapiens
aatccagttccatatttacttccg

SEQ ID NO: 33606 - DNA, 24 bp, Homo sapiens
ttcactttctcactctgtcgccca

SEQ ID NO: 33607 - DNA, 24 bp, Homo sapiens
cttatcttcgtgtaatagccagcg

SEQ ID NO: 33608 - DNA, 24 bp, Homo sapiens
gcgtgattcttagtgacaaatacc

SEQ ID NO: 33609 - DNA, 24 bp, Homo sapiens
gctcactgccacctctgcctcctg

SEQ ID NO: 33610 - DNA, 24 bp, Homo sapiens
gcacaccaccacgctcagctaatt

SEQ ID NO: 33611 - DNA, 24 bp, Homo sapiens
ggagtgtgaacaatgtggtgaaga

SEQ ID NO: 33612 - DNA, 24 bp, Homo sapiens
gctcactgccacctctgcctcctg

SEQ ID NO: 33613 - DNA, 24 bp, Homo sapiens
gcacaccaccacgctcagctaatt

SEQ ID NO: 33614 - DNA, 24 bp, Homo sapiens
gccatgctggagtatagtggtgag

SEQ ID NO: 33615 - DNA, 24 bp, Homo sapiens
aagaaggaataataaacctggttt

SEQ ID NO: 33616 - DNA, 24 bp, Homo sapiens
aaagaaggaataataaacctggtt

SEQ ID NO: 33617 - DNA, 24 bp, Homo sapiens
taaagaaggaataataaacctggt

SEQ ID NO: 33618 - DNA, 24 bp, Homo sapiens
gggacatggaagtggacgaccaaa

SEQ ID NO: 33619 - DNA, 24 bp, Homo sapiens
ggtgtcaaactttgttccctggat

SEQ ID NO: 33620 - DNA, 24 bp, Homo sapiens
cgctggctcacacctgtaatccca

SEQ ID NO: 33621 - DNA, 24 bp, Homo sapiens
cagaaattaaagtaggtgtcatgg

SEQ ID NO: 33622 - DNA, 24 bp, Homo sapiens
tcagaaattaaagtaggtgtcatg

SEQ ID NO: 33623 - DNA, 24 bp, Homo sapiens
ttcagaaattaaagtaggtgtcat

SEQ ID NO: 33624 - DNA, 24 bp, Homo sapiens
agagcaggaagcatctgtggcatc

SEQ ID NO: 33625 - DNA, 25 bp, Homo sapiens
tccagtgtgtgcctcatctcatcag

SEQ ID NO: 33626 - DNA, 25 bp, Homo sapiens
acttgaccatgtacggcataatcca

SEQ ID NO: 33627 - DNA, 23 bp, Homo sapiens
gaagaagcgcaaggtgcagagct

SEQ ID NO: 33628 - DNA, 23 bp, Homo sapiens
agctgcggctgctggaggccatg

SEQ ID NO: 33629 - DNA, 23 bp, Homo sapiens
gagcagcgccggctgagccgcgc

SEQ ID NO: 33630 - DNA, 24 bp, Homo sapiens
tcttggcaaaggtatagttaaact

SEQ ID NO: 33631 - DNA, 24 bp, Homo sapiens
gtcttggcaaaggtatagttaaac

SEQ ID NO: 33632 - DNA, 24 bp, Homo sapiens
agtcttggcaaaggtatagttaaa

SEQ ID NO: 33633 - DNA, 25 bp, Homo sapiens
ggcacagatgagacataccgcatat

SEQ ID NO: 33634 - DNA, 25 bp, Homo sapiens
aggaagtggaagaggaagatgtagc

SEQ ID NO: 33635 - DNA, 23 bp, Homo sapiens
ccacccaatccaaagatgccgct

SEQ ID NO: 33636 - DNA, 24 bp, Homo sapiens
taaataacaagaatgccaggaccc

SEQ ID NO: 33637 - DNA, 24 bp, Homo sapiens
ttaaataacaagaatgccaggacc

SEQ ID NO: 33638 - DNA, 24 bp, Homo sapiens
cttaaataacaagaatgccaggac

SEQ ID NO: 33639 - DNA, 25 bp, Homo sapiens
gtcaatcactatcacgccctctaca

SEQ ID NO: 33640 - DNA, 24 bp, Homo sapiens
gcttccacctgcctcaccttcatc

SEQ ID NO: 33641 - DNA, 23 bp, Homo sapiens
cccagcgcctccaccccaccgag

SEQ ID NO: 33642 - DNA, 24 bp, Homo sapiens
ttacattacagcttataatggcaa

SEQ ID NO: 33643 - DNA, 24 bp, Homo sapiens
attacattacagcttataatggca

SEQ ID NO: 33644 - DNA, 24 bp, Homo sapiens
tattacattacagcttataatggc

SEQ ID NO: 33645 - DNA, 24 bp, Homo sapiens
cactggctggcctcttcggtgcgg

SEQ ID NO: 33646 - DNA, 24 bp, Homo sapiens
caagatggtgatgctgctgctgct

SEQ ID NO: 33647 - DNA, 24 bp, Homo sapiens
agacaggcatctcaaatcggctga

SEQ ID NO: 33648 - DNA, 24 bp, Homo sapiens
caagatggtgatgctgctgctgct

SEQ ID NO: 33649 - DNA, 24 bp, Homo sapiens
gcggcagagggacaagcatttcat

SEQ ID NO: 33650 - DNA, 24 bp, Homo sapiens
acaacctttgagaatggacgctgc

SEQ ID NO: 33651 - DNA, 24 bp, Homo sapiens
ccgccatgctggcctctctggagt

SEQ ID NO: 33652 - DNA, 24 bp, Homo sapiens
accgccatgctggcctctctggag

SEQ ID NO: 33653 - DNA, 24 bp, Homo sapiens
caccgccatgctggcctctctgga

SEQ ID NO: 33654 - DNA, 25 bp, Homo sapiens
tgatctcaactcactgcaacctctg

SEQ ID NO: 33655 - DNA, 24 bp, Homo sapiens
caggaggattcgacgttcagtgcc

SEQ ID NO: 33656 - DNA, 23 bp, Homo sapiens
cggttctcgccggttctcagccg

SEQ ID NO: 33657 - DNA, 24 bp, Homo sapiens
tcggctgtgaatccatctggtcct

SEQ ID NO: 33658 - DNA, 23 bp, Homo sapiens
ggcactttgggtcctgagcactg

SEQ ID NO: 33659 - DNA, 25 bp, Homo sapiens
tgagagttctttgagagcagacccg

SEQ ID NO: 33660 - DNA, 23 bp, Homo sapiens
aaggaaggcggcaggaaggcgaa

SEQ ID NO: 33661 - DNA, 24 bp, Homo sapiens
gagccgagcagcaaagtgagacat

SEQ ID NO: 33662 - DNA, 25 bp, Homo sapiens
gttgggaaacttgcgggtcctagaa

SEQ ID NO: 33663 - DNA, 25 bp, Homo sapiens
ggatgcttatggaatgtgcgagaac

SEQ ID NO: 33664 - DNA, 25 bp, Homo sapiens
agtctcactgtgttcccaggctgat

SEQ ID NO: 33665 - DNA, 23 bp, Homo sapiens
ctcaagccagccaccagccttgg

SEQ ID NO: 33666 - DNA, 23 bp, Homo sapiens
gtacctggctacctcctggtgca

SEQ ID NO: 33667 - DNA, 24 bp, Homo sapiens
tgtggtgaatgctgctggctatgc

SEQ ID NO: 33668 - DNA, 23 bp, Homo sapiens
agtggtggtgctggctgcgttcc

SEQ ID NO: 33669 - DNA, 23 bp, Homo sapiens
gcctcatcatcttcctcctgtgc

SEQ ID NO: 33670 - DNA, 23 bp, Homo sapiens
acagcagcagcagcaggtggcag

SEQ ID NO: 33671 - DNA, 23 bp, Homo sapiens
ctttgacaacgagcaggacggcg

SEQ ID NO: 33672 - DNA, 23 bp, Homo sapiens
acagcagcagcagcaggtggcag

SEQ ID NO: 33673 - DNA, 23 bp, Homo sapiens
ctttgacaacgagcaggacggcg

SEQ ID NO: 33674 - DNA, 25 bp, Homo sapiens
gctactccttcttccacttctgcct

SEQ ID NO: 33675 - DNA, 23 bp, Homo sapiens
aggaagaaggaaattgccctgca

SEQ ID NO: 33676 - DNA, 24 bp, Homo sapiens
ggttcaagcgattctcctgcctca

SEQ ID NO: 33677 - DNA, 24 bp, Homo sapiens
tgtggtgatggacctctgtggaca

SEQ ID NO: 33678 - DNA, 24 bp, Homo sapiens
gcctcgcagattagtcaggatgcc

SEQ ID NO: 33679 - DNA, 24 bp, Homo sapiens
cagcgacctaacaaatacatatgg

SEQ ID NO: 33680 - DNA, 24 bp, Homo sapiens
ccagcgacctaacaaatacatatg

SEQ ID NO: 33681 - DNA, 24 bp, Homo sapiens
tccagcgacctaacaaatacatat

SEQ ID NO: 33682 - DNA, 23 bp, Homo sapiens
gtagtcatgcagcacgtcagcag

SEQ ID NO: 33683 - DNA, 23 bp, Homo sapiens
gagcagccagcgccatgtccagt

SEQ ID NO: 33684 - DNA, 23 bp, Homo sapiens
cagcgtgctcccagccgtccctg

SEQ ID NO: 33685 - DNA, 23 bp, Homo sapiens
ctgctgtgacctctatgcctgcg

SEQ ID NO: 33686 - DNA, 24 bp, Homo sapiens
ctatgagttcatcggcgtcagcgg

SEQ ID NO: 33687 - DNA, 23 bp, Homo sapiens
catcatcaccgccgccgtcctgg

SEQ ID NO: 33688 - DNA, 24 bp, Homo sapiens
ggacctggctggctggagtacaat

SEQ ID NO: 33689 - DNA, 24 bp, Homo sapiens
gggacctggctggctggagtacaa

SEQ ID NO: 33690 - DNA, 24 bp, Homo sapiens
agggacctggctggctggagtaca

SEQ ID NO: 33691 - DNA, 23 bp, Homo sapiens
ctgtggtgggtgaatgggaaggg

SEQ ID NO: 33692 - DNA, 23 bp, Homo sapiens
cctgagtggtggctggtgatcct

SEQ ID NO: 33693 - DNA, 25 bp, Homo sapiens
gtggcatctgaatgtccttctctga

SEQ ID NO: 33694 - DNA, 24 bp, Homo sapiens
tctcaagacacatgataatatcaa

SEQ ID NO: 33695 - DNA, 24 bp, Homo sapiens
atctcaagacacatgataatatca

SEQ ID NO: 33696 - DNA, 24 bp, Homo sapiens
aatctcaagacacatgataatatc

SEQ ID NO: 33697 - DNA, 24 bp, Homo sapiens
aagcctttgtctgtgcctactccc

SEQ ID NO: 33698 - DNA, 24 bp, Homo sapiens
gctgggctgtgggcggcacctgtg

SEQ ID NO: 33699 - DNA, 24 bp, Homo sapiens
ggacatcctcgccttctatctggg

SEQ ID NO: 33700 - DNA, 24 bp, Homo sapiens
ccaacgaggtgattgacagtgact

SEQ ID NO: 33701 - DNA, 24 bp, Homo sapiens
tcacctacaagaccgccaaggact

SEQ ID NO: 33702 - DNA, 24 bp, Homo sapiens
cgcctgttctccgttccttctgtc

SEQ ID NO: 33703 - DNA, 24 bp, Homo sapiens
cacaccctgaaggaggtcgctttc

SEQ ID NO: 33704 - DNA, 23 bp, Homo sapiens
gacgtggtggtggtgcggcccat

SEQ ID NO: 33705 - DNA, 24 bp, Homo sapiens
agaaaaagcagttaatgtggagct

SEQ ID NO: 33706 - DNA, 24 bp, Homo sapiens
aagaaaaagcagttaatgtggagc

SEQ ID NO: 33707 - DNA, 24 bp, Homo sapiens
taagaaaaagcagttaatgtggag

SEQ ID NO: 33708 - DNA, 24 bp, Homo sapiens
cacgaagtccttggctgagaacgg

SEQ ID NO: 33709 - DNA, 24 bp, Homo sapiens
tggcggtttatctttcaaggtccc

SEQ ID NO: 33710 - DNA, 24 bp, Homo sapiens
ctgggtgcctggtcctgctctcat

SEQ ID NO: 33711 - DNA, 24 bp, Homo sapiens
ctgctgctgcccactcttcccagt

SEQ ID NO: 33712 - DNA, 24 bp, Homo sapiens
gctctgtgatggtgtctggccgcc

SEQ ID NO: 33713 - DNA, 24 bp, Homo sapiens
gccgcccggccaccccagcttcca

SEQ ID NO: 33714 - DNA, 24 bp, Homo sapiens
atatatttcaggaacttatttttt

SEQ ID NO: 33715 - DNA, 24 bp, Homo sapiens
tatatatttcaggaacttattttt

SEQ ID NO: 33716 - DNA, 24 bp, Homo sapiens
ttatatatttcaggaacttatttt

SEQ ID NO: 33717 - DNA, 24 bp, Homo sapiens
aatattaagaagaaagcttgctgt

SEQ ID NO: 33718 - DNA, 24 bp, Homo sapiens
caatattaagaagaaagcttgctg

SEQ ID NO: 33719 - DNA, 24 bp, Homo sapiens
acaatattaagaagaaagcttgct

SEQ ID NO: 33720 - DNA, 24 bp, Homo sapiens
ggagctggcagggcagctgatcca

SEQ ID NO: 33721 - DNA, 24 bp, Homo sapiens
tggagctggcagggcagctgatcc

SEQ ID NO: 33722 - DNA, 24 bp, Homo sapiens
gtggagctggcagggcagctgatc

SEQ ID NO: 33723 - DNA, 24 bp, Homo sapiens
tgtattctcagcttcctgtgcttc

SEQ ID NO: 33724 - DNA, 24 bp, Homo sapiens
ctgtattctcagcttcctgtgctt

SEQ ID NO: 33725 - DNA, 24 bp, Homo sapiens
tctgtattctcagcttcctgtgct

SEQ ID NO: 33726 - DNA, 24 bp, Homo sapiens
aaaaaacgaagaacatggtcctga

SEQ ID NO: 33727 - DNA, 24 bp, Homo sapiens
gaaaaaacgaagaacatggtcctg

SEQ ID NO: 33728 - DNA, 24 bp, Homo sapiens
agaaaaaacgaagaacatggtcct

SEQ ID NO: 33729 - DNA, 23 bp, Homo sapiens
agcaagaaacgcttgaaagaagt

SEQ ID NO: 33730 - DNA, 24 bp, Homo sapiens
aacacgacttaaaagtggcttcag

SEQ ID NO: 33731 - DNA, 23 bp, Homo sapiens
acagccgacatcaatgacagtgg

SEQ ID NO: 33732 - DNA, 23 bp, Homo sapiens
agtggtggctgctcatctgcttg

SEQ ID NO: 33733 - DNA, 25 bp, Homo sapiens
gggcattgagactacagggaaggtg

SEQ ID NO: 33734 - DNA, 23 bp, Homo sapiens
agtggtggctgctcatctgcttg

SEQ ID NO: 33735 - DNA, 23 bp, Homo sapiens
acagccgacatcaatgacagtgg

SEQ ID NO: 33736 - DNA, 23 bp, Homo sapiens
gcgccgtgagctacttctggtac

SEQ ID NO: 33737 - DNA, 24 bp, Homo sapiens
gggacaatgaggaaaattatattt

SEQ ID NO: 33738 - DNA, 24 bp, Homo sapiens
tgggacaatgaggaaaattatatt

SEQ ID NO: 33739 - DNA, 24 bp, Homo sapiens
ttgggacaatgaggaaaattatat

SEQ ID NO: 33740 - DNA, 24 bp, Homo sapiens
gctgggtgctggtatctcctctaa

SEQ ID NO: 33741 - DNA, 24 bp, Homo sapiens
ggctgggtgctggtatctcctcta

SEQ ID NO: 33742 - DNA, 24 bp, Homo sapiens
tggctgggtgctggtatctcctct

SEQ ID NO: 33743 - DNA, 24 bp, Homo sapiens
tcttcctcctcttcggacacctgc

SEQ ID NO: 33744 - DNA, 24 bp, Homo sapiens
cgtgcggctgctgccctatgtgcg

SEQ ID NO: 33745 - DNA, 24 bp, Homo sapiens
ctgggctgcctgctgggcgagacc

SEQ ID NO: 33746 - DNA, 24 bp, Homo sapiens
gctgggtgctggtgaaggtgccga

SEQ ID NO: 33747 - DNA, 24 bp, Homo sapiens
ggctgggtgctggtgaaggtgccg

SEQ ID NO: 33748 - DNA, 24 bp, Homo sapiens
tggctgggtgctggtgaaggtgcc

SEQ ID NO: 33749 - DNA, 24 bp, Homo sapiens
caccagcttgttggcgtcttcgtc

SEQ ID NO: 33750 - DNA, 24 bp, Homo sapiens
tcgccttagtcgtcacccttctcc

SEQ ID NO: 33751 - DNA, 24 bp, Homo sapiens
cggctgcggctgctgtaaggtctg

SEQ ID NO: 33752 - DNA, 23 bp, Homo sapiens
gcggctcttcagcaacaaggtgg

SEQ ID NO: 33753 - DNA, 23 bp, Homo sapiens
cagacgccagcccagacacccag

SEQ ID NO: 33754 - DNA, 23 bp, Homo sapiens
cccatccctgacctggcgaaagg

SEQ ID NO: 33755 - DNA, 24 bp, Homo sapiens
acacctgttctcccgaatttgact

SEQ ID NO: 33756 - DNA, 24 bp, Homo sapiens
gcctgagtgatcttatagcagccg

SEQ ID NO: 33757 - DNA, 24 bp, Homo sapiens
gtgcctggtggtgtggaacaatca

SEQ ID NO: 33758 - DNA, 24 bp, Homo sapiens
cccttccaatgcagctaaccctcc

SEQ ID NO: 33759 - DNA, 24 bp, Homo sapiens
ccttgagccgagattgtgccactg

SEQ ID NO: 33760 - DNA, 24 bp, Homo sapiens
aggaaatcaaaagaaaagcataca

SEQ ID NO: 33761 - DNA, 24 bp, Homo sapiens
gagagtgtggagaggctgcgtgga

SEQ ID NO: 33762 - DNA, 24 bp, Homo sapiens
ccgttggcttccctgacacacttc

SEQ ID NO: 33763 - DNA, 24 bp, Homo sapiens
ttcagacttagtcgccagcaaggt

SEQ ID NO: 33764 - DNA, 24 bp, Homo sapiens
tgggaggactgtggatgattatga

SEQ ID NO: 33765 - DNA, 24 bp, Homo sapiens
tcaagaccattattgaagcacctt

SEQ ID NO: 33766 - DNA, 24 bp, Homo sapiens
ggcttactgaatatcctcttgtaa

SEQ ID NO: 33767 - DNA, 23 bp, Homo sapiens
caggacgacagcagcagcagcac

SEQ ID NO: 33768 - DNA, 23 bp, Homo sapiens
tctgctagagtccatccgccaag

SEQ ID NO: 33769 - DNA, 24 bp, Homo sapiens
gcagaaggagcaggagcaagtgag

SEQ ID NO: 33770 - DNA, 24 bp, Homo sapiens
agggaaccctggcgaagtccgcct

SEQ ID NO: 33771 - DNA, 24 bp, Homo sapiens
aagggaaccctggcgaagtccgcc

SEQ ID NO: 33772 - DNA, 24 bp, Homo sapiens
aaagggaaccctggcgaagtccgc

SEQ ID NO: 33773 - DNA, 24 bp, Homo sapiens
ctcccgtactgtcaacaaccatgc

SEQ ID NO: 33774 - DNA, 24 bp, Homo sapiens
ccctggtggagtatttcacacagc

SEQ ID NO: 33775 - DNA, 24 bp, Homo sapiens
ctccatctcagcccagcctcaacg

SEQ ID NO: 33776 - DNA, 24 bp, Homo sapiens
aggctctggtggacgctggtgttc

SEQ ID NO: 33777 - DNA, 24 bp, Homo sapiens
gctgtggtctcgccatacaacctc

SEQ ID NO: 33778 - DNA, 24 bp, Homo sapiens
ctcccgtactgtcaacaaccatgc

SEQ ID NO: 33779 - DNA, 24 bp, Homo sapiens
aaattagccagtgaagaaatggaa

SEQ ID NO: 33780 - DNA, 24 bp, Homo sapiens
aaaattagccagtgaagaaatgga

SEQ ID NO: 33781 - DNA, 24 bp, Homo sapiens
aaaaattagccagtgaagaaatgg

SEQ ID NO: 33782 - DNA, 25 bp, Homo sapiens
gctgaaggaggtggtggacaaacaa

SEQ ID NO: 33783 - DNA, 23 bp, Homo sapiens
ctttacagcagcagcagacacgg

SEQ ID NO: 33784 - DNA, 25 bp, Homo sapiens
aagatcaaccatgaccttcggcacc

SEQ ID NO: 33785 - DNA, 23 bp, Homo sapiens
agccacagcagccagaaatgagc

SEQ ID NO: 33786 - DNA, 25 bp, Homo sapiens
agaacttcagtccctcatggctgtg

SEQ ID NO: 33787 - DNA, 25 bp, Homo sapiens
tgaatgctccttggctgagactgaa

SEQ ID NO: 33788 - DNA, 25 bp, Homo sapiens
tctcgcactcttccaagtctccagt

SEQ ID NO: 33789 - DNA, 25 bp, Homo sapiens
ggtctccagttccatccatgttgct

SEQ ID NO: 33790 - DNA, 25 bp, Homo sapiens
ctgcttcagcctaactcacttctgc

SEQ ID NO: 33791 - DNA, 23 bp, Homo sapiens
gcaagcagtcgcctgtccactta

SEQ ID NO: 33792 - DNA, 23 bp, Homo sapiens
gccttgcttgctttcttctctgg

SEQ ID NO: 33793 - DNA, 23 bp, Homo sapiens
ctggagacaggggcctcggtcaa

SEQ ID NO: 33794 - DNA, 25 bp, Homo sapiens
gcttcggatgatggagacagaaatc

SEQ ID NO: 33795 - DNA, 25 bp, Homo sapiens
gtgatgctggagaacttcaggaacc

SEQ ID NO: 33796 - DNA, 25 bp, Homo sapiens
ggaccttgcccagagaaagctgtac

SEQ ID NO: 33797 - DNA, 23 bp, Homo sapiens
ctggctggtgctggatgtcacag

SEQ ID NO: 33798 - DNA, 24 bp, Homo sapiens
ctggttgctgaagcgtcacaagga

SEQ ID NO: 33799 - DNA, 23 bp, Homo sapiens
tccgcctctatgtggagactgag

SEQ ID NO: 33800 - DNA, 24 bp, Homo sapiens
ctggttgctgaagcgtcacaagga

SEQ ID NO: 33801 - DNA, 23 bp, Homo sapiens
ctggctggtgctggatgtcacag

SEQ ID NO: 33802 - DNA, 24 bp, Homo sapiens
ttggatcttcagacgctccgagct

SEQ ID NO: 33803 - DNA, 24 bp, Homo sapiens
ctggttgctgaagcgtcacaagga

SEQ ID NO: 33804 - DNA, 23 bp, Homo sapiens
ctggctggtgctggatgtcacag

SEQ ID NO: 33805 - DNA, 23 bp, Homo sapiens
cgtcagcatgttccaggtggtcc

SEQ ID NO: 33806 - DNA, 24 bp, Homo sapiens
gacgtggattggtgctgcacccct

SEQ ID NO: 33807 - DNA, 24 bp, Homo sapiens
tgacgtggattggtgctgcacccc

SEQ ID NO: 33808 - DNA, 24 bp, Homo sapiens
gtgacgtggattggtgctgcaccc

SEQ ID NO: 33809 - DNA, 25 bp, Homo sapiens
ccctaaaccctctctgtcagcctgg

SEQ ID NO: 33810 - DNA, 23 bp, Homo sapiens
aggacatcacccttcagtgccga

SEQ ID NO: 33811 - DNA, 25 bp, Homo sapiens
gatggagaagaagcacctcagcagt

SEQ ID NO: 33812 - DNA, 25 bp, Homo sapiens
ccgctcttcctgggtgtaatgttaa

SEQ ID NO: 33813 - DNA, 25 bp, Homo sapiens
gcagagcctgtggattaccaagtcc

SEQ ID NO: 33814 - DNA, 25 bp, Homo sapiens
tctccattgacaacctgacacctga

SEQ ID NO: 33815 - DNA, 24 bp, Homo sapiens
ctccatttaagcaggcacctctgt

SEQ ID NO: 33816 - DNA, 24 bp, Homo sapiens
tctccatttaagcaggcacctctg

SEQ ID NO: 33817 - DNA, 24 bp, Homo sapiens
atctccatttaagcaggcacctct

SEQ ID NO: 33818 - DNA, 24 bp, Homo sapiens
aaatgaaactggtaataaaactgt

SEQ ID NO: 33819 - DNA, 24 bp, Homo sapiens
gaaatgaaactggtaataaaactg

SEQ ID NO: 33820 - DNA, 24 bp, Homo sapiens
ggaaatgaaactggtaataaaact

SEQ ID NO: 33821 - DNA, 24 bp, Homo sapiens
aaatctgaatggtacgttatttta

SEQ ID NO: 33822 - DNA, 24 bp, Homo sapiens
aaaatctgaatggtacgttatttt

SEQ ID NO: 33823 - DNA, 24 bp, Homo sapiens
taaaatctgaatggtacgttattt

SEQ ID NO: 33824 - DNA, 24 bp, Homo sapiens
agagagaaaagaaagatagagtct

SEQ ID NO: 33825 - DNA, 24 bp, Homo sapiens
aagagagaaaagaaagatagagtc

SEQ ID NO: 33826 - DNA, 24 bp, Homo sapiens
caagagagaaaagaaagatagagt

SEQ ID NO: 33827 - DNA, 24 bp, Homo sapiens
ggctgtgctgggcctggtgtccct

SEQ ID NO: 33828 - DNA, 24 bp, Homo sapiens
gggctgtgctgggcctggtgtccc

SEQ ID NO: 33829 - DNA, 24 bp, Homo sapiens
ggggctgtgctgggcctggtgtcc

SEQ ID NO: 33830 - DNA, 25 bp, Homo sapiens
gccactgtacctcttcaacaccacg

SEQ ID NO: 33831 - DNA, 25 bp, Homo sapiens
gccacattgcctctcatctccaacc

SEQ ID NO: 33832 - DNA, 24 bp, Homo sapiens
agtgtgctgggtgtggtgaatgag

SEQ ID NO: 33833 - DNA, 23 bp, Homo sapiens
gctgctgcccacaccactctttg

SEQ ID NO: 33834 - DNA, 25 bp, Homo sapiens
acagatgctcttcaaggtgcttccg

SEQ ID NO: 33835 - DNA, 24 bp, Homo sapiens
agtgtgctgggtgtggtgaatgag

SEQ ID NO: 33836 - DNA, 24 bp, Homo sapiens
agggagttaagaaggaatcaagac

SEQ ID NO: 33837 - DNA, 24 bp, Homo sapiens
aagggagttaagaaggaatcaaga

SEQ ID NO: 33838 - DNA, 24 bp, Homo sapiens
taagggagttaagaaggaatcaag

SEQ ID NO: 33839 - DNA, 23 bp, Homo sapiens
atcctggtgcccaacggcttctc

SEQ ID NO: 33840 - DNA, 23 bp, Homo sapiens
cgacgccgcagccgccgcccgtg

SEQ ID NO: 33841 - DNA, 23 bp, Homo sapiens
cagccgcccggcagcgagcctgg

SEQ ID NO: 33842 - DNA, 24 bp, Homo sapiens
aaaatgtcaaggttccagaagcca

SEQ ID NO: 33843 - DNA, 24 bp, Homo sapiens
gaaaatgtcaaggttccagaagcc

SEQ ID NO: 33844 - DNA, 24 bp, Homo sapiens
cgaaaatgtcaaggttccagaagc

SEQ ID NO: 33845 - DNA, 24 bp, Homo sapiens
ggttcttggtctcactgacttcaa

SEQ ID NO: 33846 - DNA, 25 bp, Homo sapiens
ttgagcctactaggatggaatgaat

SEQ ID NO: 33847 - DNA, 25 bp, Homo sapiens
caggatgaagtcacacccatatttg

SEQ ID NO: 33848 - DNA, 25 bp, Homo sapiens
ctcctgaagcaagcaagaccacgaa

SEQ ID NO: 33849 - DNA, 25 bp, Homo sapiens
attccgaacacatccgaacatcagc

SEQ ID NO: 33850 - DNA, 24 bp, Homo sapiens
ttaagagctgcaacactccctggg

SEQ ID NO: 33851 - DNA, 23 bp, Homo sapiens
ctcaccaggattgtgggcggcag

SEQ ID NO: 33852 - DNA, 23 bp, Homo sapiens
gagaggtggctgctgtcggcggc

SEQ ID NO: 33853 - DNA, 25 bp, Homo sapiens
cgcatctacaagcacccgttctaca

SEQ ID NO: 33854 - DNA, 23 bp, Homo sapiens
cagacctgccgccgcttctaccc

SEQ ID NO: 33855 - DNA, 23 bp, Homo sapiens
agcagccgcatgctgtgtgccgg

SEQ ID NO: 33856 - DNA, 23 bp, Homo sapiens
agaaggcggccgtgcgcctcctc

SEQ ID NO: 33857 - DNA, 24 bp, Homo sapiens
tctctaaacaggtgatgaaattct

SEQ ID NO: 33858 - DNA, 24 bp, Homo sapiens
ctctctaaacaggtgatgaaattc

SEQ ID NO: 33859 - DNA, 24 bp, Homo sapiens
tctctctaaacaggtgatgaaatt

SEQ ID NO: 33860 - DNA, 23 bp, Homo sapiens
gtctcactctgttgcccaggctg

SEQ ID NO: 33861 - DNA, 23 bp, Homo sapiens
cgagatggagctgagggaaggca

SEQ ID NO: 33862 - DNA, 23 bp, Homo sapiens
gcggtgcaatcccggctcactgc

SEQ ID NO: 33863 - DNA, 25 bp, Homo sapiens
ttcctgtttcctaaagcctgccacc

SEQ ID NO: 33864 - DNA, 25 bp, Homo sapiens
acgcagcaactcaaccagtgttaat

SEQ ID NO: 33865 - DNA, 25 bp, Homo sapiens
gcttcagtcatctccaacatcgtgc

SEQ ID NO: 33866 - DNA, 24 bp, Homo sapiens
caactcaaccaggaacttcgagac

SEQ ID NO: 33867 - DNA, 24 bp, Homo sapiens
gcaactcaaccaggaacttcgaga

SEQ ID NO: 33868 - DNA, 24 bp, Homo sapiens
agcaactcaaccaggaacttcgag

SEQ ID NO: 33869 - DNA, 24 bp, Homo sapiens
tgaatgggacgaaggagagggacg

SEQ ID NO: 33870 - DNA, 24 bp, Homo sapiens
gaccatctccagccgacctctctc

SEQ ID NO: 33871 - DNA, 24 bp, Homo sapiens
gacactctccgcagatcatctcct

SEQ ID NO: 33872 - DNA, 24 bp, Homo sapiens
aagtaaaaatggtaagtttgtttt

SEQ ID NO: 33873 - DNA, 24 bp, Homo sapiens
gaagtaaaaatggtaagtttgttt

SEQ ID NO: 33874 - DNA, 24 bp, Homo sapiens
agaagtaaaaatggtaagtttgtt

SEQ ID NO: 33875 - DNA, 24 bp, Homo sapiens
tctttctctaggttcatggaaatc

SEQ ID NO: 33876 - DNA, 24 bp, Homo sapiens
ttctttctctaggttcatggaaat

SEQ ID NO: 33877 - DNA, 24 bp, Homo sapiens
tttctttctctaggttcatggaaa

SEQ ID NO: 33878 - DNA, 24 bp, Homo sapiens
cctgttcatgggtaagctctttac

SEQ ID NO: 33879 - DNA, 24 bp, Homo sapiens
tcctgttcatgggtaagctcttta

SEQ ID NO: 33880 - DNA, 24 bp, Homo sapiens
ttcctgttcatgggtaagctcttt

SEQ ID NO: 33881 - DNA, 24 bp, Homo sapiens
ccatgaagaggagctcagacagct

SEQ ID NO: 33882 - DNA, 24 bp, Homo sapiens
agtacagtataaaacttcacagtg

SEQ ID NO: 33883 - DNA, 24 bp, Homo sapiens
catgatacaagagccggctggtgg

SEQ ID NO: 33884 - DNA, 24 bp, Homo sapiens
ggaccccatagattcaacttatca

SEQ ID NO: 33885 - DNA, 24 bp, Homo sapiens
tggaccccatagattcaacttatc

SEQ ID NO: 33886 - DNA, 24 bp, Homo sapiens
gtggaccccatagattcaacttat

SEQ ID NO: 33887 - DNA, 24 bp, Homo sapiens
tgctccccgccgcttccgtttctc

SEQ ID NO: 33888 - DNA, 24 bp, Homo sapiens
cgcccctcgcctaacctcccgccg

SEQ ID NO: 33889 - DNA, 24 bp, Homo sapiens
gatccggtgccgagccaagcgggg

SEQ ID NO: 33890 - DNA, 24 bp, Homo sapiens
agtctccacctctcaggctcaagg

SEQ ID NO: 33891 - DNA, 24 bp, Homo sapiens
ggtcccactatgttgcccagtcct

SEQ ID NO: 33892 - DNA, 24 bp, Homo sapiens
gcctaagaaccagctctcctgtat

SEQ ID NO: 33893 - DNA, 24 bp, Homo sapiens
tggaggctctactgattttgcatg

SEQ ID NO: 33894 - DNA, 24 bp, Homo sapiens
cttttggttcacggcgatgcattc

SEQ ID NO: 33895 - DNA, 24 bp, Homo sapiens
gctgcctgacccccacctgccact

SEQ ID NO: 33896 - DNA, 24 bp, Homo sapiens
cgatctcctgaccttgtgatccac

SEQ ID NO: 33897 - DNA, 24 bp, Homo sapiens
tcacagctctatgaggttatcact

SEQ ID NO: 33898 - DNA, 24 bp, Homo sapiens
ccaccgcaccgggcctaaatcagg

SEQ ID NO: 33899 - DNA, 24 bp, Homo sapiens
agctgcccacgctcaaaccaattc

SEQ ID NO: 33900 - DNA, 24 bp, Homo sapiens
cagctgcccacgctcaaaccaatt

SEQ ID NO: 33901 - DNA, 24 bp, Homo sapiens
ccagctgcccacgctcaaaccaat

SEQ ID NO: 33902 - DNA, 24 bp, Homo sapiens
ccgcatcttcaccttcattgctgg

SEQ ID NO: 33903 - DNA, 24 bp, Homo sapiens
acacaggatatgccatcaacccgt

SEQ ID NO: 33904 - DNA, 24 bp, Homo sapiens
tggtgataggcatcctcgtggtca

SEQ ID NO: 33905 - DNA, 24 bp, Homo sapiens
tattgttttaggagtatccgattt

SEQ ID NO: 33906 - DNA, 24 bp, Homo sapiens
atattgttttaggagtatccgatt

SEQ ID NO: 33907 - DNA, 24 bp, Homo sapiens
aatattgttttaggagtatccgat

SEQ ID NO: 33908 - DNA, 24 bp, Homo sapiens
gcctcccaggttcaagcgattctc

SEQ ID NO: 33909 - DNA, 24 bp, Homo sapiens
ctggaatgcagtggctccatctcc

SEQ ID NO: 33910 - DNA, 24 bp, Homo sapiens
ccgcccacgtcactgggattacag

SEQ ID NO: 33911 - DNA, 23 bp, Homo sapiens
ggctgaggaggctggagtggctt

SEQ ID NO: 33912 - DNA, 23 bp, Homo sapiens
atctacaagaagcacctggaccc

SEQ ID NO: 33913 - DNA, 23 bp, Homo sapiens
cacactgcaagcaggtctggctg

SEQ ID NO: 33914 - DNA, 24 bp, Homo sapiens
gcacctgctgcatgatattggttt

SEQ ID NO: 33915 - DNA, 24 bp, Homo sapiens
atgttgaatcctttattggaatga

SEQ ID NO: 33916 - DNA, 24 bp, Homo sapiens
cagttgcactctcctccagatagt

SEQ ID NO: 33917 - DNA, 24 bp, Homo sapiens
ccagttgcactctcctccagatag

SEQ ID NO: 33918 - DNA, 24 bp, Homo sapiens
cccagttgcactctcctccagata

SEQ ID NO: 33919 - DNA, 24 bp, Homo sapiens
agtaagcttggatttgaaatcgtt

SEQ ID NO: 33920 - DNA, 24 bp, Homo sapiens
aagtaagcttggatttgaaatcgt

SEQ ID NO: 33921 - DNA, 24 bp, Homo sapiens
taagtaagcttggatttgaaatcg

SEQ ID NO: 33922 - DNA, 24 bp, Homo sapiens
ataaaatagaaatggggaataaac

SEQ ID NO: 33923 - DNA, 24 bp, Homo sapiens
gataaaatagaaatggggaataaa

SEQ ID NO: 33924 - DNA, 24 bp, Homo sapiens
agataaaatagaaatggggaataa

SEQ ID NO: 33925 - DNA, 24 bp, Homo sapiens
ttgataaacttaccaaagagccaa

SEQ ID NO: 33926 - DNA, 24 bp, Homo sapiens
tttgataaacttaccaaagagcca

SEQ ID NO: 33927 - DNA, 24 bp, Homo sapiens
ttttgataaacttaccaaagagcc

SEQ ID NO: 33928 - DNA, 24 bp, Homo sapiens
ttgataaacttgtaagtactgttt

SEQ ID NO: 33929 - DNA, 24 bp, Homo sapiens
tttgataaacttgtaagtactgtt

SEQ ID NO: 33930 - DNA, 24 bp, Homo sapiens
ttttgataaacttgtaagtactgt

SEQ ID NO: 33931 - DNA, 24 bp, Homo sapiens
acaatcccactcccttcccaaacc

SEQ ID NO: 33932 - DNA, 24 bp, Homo sapiens
ctctgagaacccactgaagcggct

SEQ ID NO: 33933 - DNA, 24 bp, Homo sapiens
gttcgaggtgacagccttctaccg

SEQ ID NO: 33934 - DNA, 24 bp, Homo sapiens
gattatatcaggtatggcatttac

SEQ ID NO: 33935 - DNA, 24 bp, Homo sapiens
agattatatcaggtatggcattta

SEQ ID NO: 33936 - DNA, 24 bp, Homo sapiens
gagattatatcaggtatggcattt

SEQ ID NO: 33937 - DNA, 24 bp, Homo sapiens
attattcacaggactgggtcatgc

SEQ ID NO: 33938 - DNA, 24 bp, Homo sapiens
cattattcacaggactgggtcatg

SEQ ID NO: 33939 - DNA, 24 bp, Homo sapiens
tcattattcacaggactgggtcat

SEQ ID NO: 33940 - DNA, 24 bp, Homo sapiens
cttttataaaagtaagtaaataca

SEQ ID NO: 33941 - DNA, 24 bp, Homo sapiens
acttttataaaagtaagtaaatac

SEQ ID NO: 33942 - DNA, 24 bp, Homo sapiens
aacttttataaaagtaagtaaata

SEQ ID NO: 33943 - DNA, 24 bp, Homo sapiens
cttctcaaaatgtgcgtatatcag

SEQ ID NO: 33944 - DNA, 24 bp, Homo sapiens
tcttctcaaaatgtgcgtatatca

SEQ ID NO: 33945 - DNA, 24 bp, Homo sapiens
ctcttctcaaaatgtgcgtatatc

SEQ ID NO: 33946 - DNA, 24 bp, Homo sapiens
cacctttacagctcggcttcttca

SEQ ID NO: 33947 - DNA, 24 bp, Homo sapiens
tcacctttacagctcggcttcttc

SEQ ID NO: 33948 - DNA, 24 bp, Homo sapiens
atcacctttacagctcggcttctt

SEQ ID NO: 33949 - DNA, 24 bp, Homo sapiens
tgggaatcagtattacacaacggg

SEQ ID NO: 33950 - DNA, 24 bp, Homo sapiens
agccctgcccttccctcatagatg

SEQ ID NO: 33951 - DNA, 24 bp, Homo sapiens
tgccaataatccaagagttgtgtt

SEQ ID NO: 33952 - DNA, 24 bp, Homo sapiens
agggaaagtgcatacaacactgga

SEQ ID NO: 33953 - DNA, 24 bp, Homo sapiens
agcaaccaaaacaaaaggttaaca

SEQ ID NO: 33954 - DNA, 24 bp, Homo sapiens
gttgatttttcagaaaacttgttt

SEQ ID NO: 33955 - DNA, 24 bp, Homo sapiens
ctcagcctcaatgtgtccctaccg

SEQ ID NO: 33956 - DNA, 24 bp, Homo sapiens
agcagacacgaatcgtcctggact

SEQ ID NO: 33957 - DNA, 24 bp, Homo sapiens
cagaagaaggagaatgagaccagg

SEQ ID NO: 33958 - DNA, 24 bp, Homo sapiens
ttttagaaatggtaagtaagtcta

SEQ ID NO: 33959 - DNA, 24 bp, Homo sapiens
attttagaaatggtaagtaagtct

SEQ ID NO: 33960 - DNA, 24 bp, Homo sapiens
cattttagaaatggtaagtaagtc

SEQ ID NO: 33961 - DNA, 24 bp, Homo sapiens
cctgtggcctggtgagctggtgcc

SEQ ID NO: 33962 - DNA, 24 bp, Homo sapiens
ccctgtggcctggtgagctggtgc

SEQ ID NO: 33963 - DNA, 24 bp, Homo sapiens
accctgtggcctggtgagctggtg

SEQ ID NO: 33964 - DNA, 24 bp, Homo sapiens
ccttcttcggattctcagtggagt

SEQ ID NO: 33965 - DNA, 24 bp, Homo sapiens
gggcttcaacttagacgcggaggc

SEQ ID NO: 33966 - DNA, 24 bp, Homo sapiens
ctgctgccgctgctgttgctgctg

SEQ ID NO: 33967 - DNA, 24 bp, Homo sapiens
gcaaggcagcgagtggaccagatc

SEQ ID NO: 33968 - DNA, 24 bp, Homo sapiens
atgattggtcgctgctttgtgctc

SEQ ID NO: 33969 - DNA, 24 bp, Homo sapiens
aatggaagttctgtgagggacgcc

SEQ ID NO: 33970 - DNA, 24 bp, Homo sapiens
tggaccctgcggtcaccttctacc

SEQ ID NO: 33971 - DNA, 24 bp, Homo sapiens
ctggaccctgcggtcaccttctac

SEQ ID NO: 33972 - DNA, 24 bp, Homo sapiens
cctggaccctgcggtcaccttcta

SEQ ID NO: 33973 - DNA, 24 bp, Homo sapiens
accaccatcaggaggagcaaatga

SEQ ID NO: 33974 - DNA, 24 bp, Homo sapiens
aaccaccatcaggaggagcaaatg

SEQ ID NO: 33975 - DNA, 24 bp, Homo sapiens
gaaccaccatcaggaggagcaaat

SEQ ID NO: 33976 - DNA, 24 bp, Homo sapiens
gtggctgacaggtggcttgcggcc

SEQ ID NO: 33977 - DNA, 24 bp, Homo sapiens
ggtggctgacaggtggcttgcggc

SEQ ID NO: 33978 - DNA, 24 bp, Homo sapiens
tggtggctgacaggtggcttgcgg

SEQ ID NO: 33979 - DNA, 24 bp, Homo sapiens
cagcatcgtgtcagtggagcggat

SEQ ID NO: 33980 - DNA, 24 bp, Homo sapiens
gactggtggctgacaggtggcttg

SEQ ID NO: 33981 - DNA, 24 bp, Homo sapiens
gctactcgtctgtctgctcccaca

SEQ ID NO: 33982 - DNA, 24 bp, Homo sapiens
gaagatccacttcaccttcaccca

SEQ ID NO: 33983 - DNA, 24 bp, Homo sapiens
gaccagcccgagccagcagagcct

SEQ ID NO: 33984 - DNA, 24 bp, Homo sapiens
cccatcgtccaactgaaaggcctg

SEQ ID NO: 33985 - DNA, 24 bp, Homo sapiens
ctggcatcatccgctacgctatcg

SEQ ID NO: 33986 - DNA, 24 bp, Homo sapiens
gccaggcaggagctgaataccatc

SEQ ID NO: 33987 - DNA, 24 bp, Homo sapiens
tccttccagcacgagatgtcccaa

SEQ ID NO: 33988 - DNA, 24 bp, Homo sapiens
acggcaccttcatagtcacattcg

SEQ ID NO: 33989 - DNA, 24 bp, Homo sapiens
gggagacaggatgcttatgagggc

SEQ ID NO: 33990 - DNA, 24 bp, Homo sapiens
gcaggcaggaagaatccaccaagt

SEQ ID NO: 33991 - DNA, 24 bp, Homo sapiens
tgaagggcaatctcagtttcggct

SEQ ID NO: 33992 - DNA, 24 bp, Homo sapiens
gtgttggtcgtgagtgtggctgaa

SEQ ID NO: 33993 - DNA, 24 bp, Homo sapiens
tggagatggtgctagaagaagacg

SEQ ID NO: 33994 - DNA, 24 bp, Homo sapiens
cgccgggaggcactttggataccg

SEQ ID NO: 33995 - DNA, 24 bp, Homo sapiens
tcgagctacaacctggacgtgcgg

SEQ ID NO: 33996 - DNA, 24 bp, Homo sapiens
atggcgctgctgtctgggttcttt

SEQ ID NO: 33997 - DNA, 24 bp, Homo sapiens
ctttgggaatggtttatatttatg

SEQ ID NO: 33998 - DNA, 24 bp, Homo sapiens
actttgggaatggtttatatttat

SEQ ID NO: 33999 - DNA, 24 bp, Homo sapiens
gactttgggaatggtttatattta

SEQ ID NO: 34000 - DNA, 24 bp, Homo sapiens
ggagcgagagcctgttggaacatg

SEQ ID NO: 34001 - DNA, 24 bp, Homo sapiens
tggtttggagcatctgtgaggtcg

SEQ ID NO: 34002 - DNA, 24 bp, Homo sapiens
ctcccaaagcaaacaccacccagc

SEQ ID NO: 34003 - DNA, 24 bp, Homo sapiens
tgctcaaacagattttctataaga

SEQ ID NO: 34004 - DNA, 24 bp, Homo sapiens
ttgctcaaacagattttctataag

SEQ ID NO: 34005 - DNA, 24 bp, Homo sapiens
tttgctcaaacagattttctataa

SEQ ID NO: 34006 - DNA, 24 bp, Homo sapiens
ggactccagcacaccgagggacat

SEQ ID NO: 34007 - DNA, 24 bp, Homo sapiens
aaagcccccacgcccagccaggag

SEQ ID NO: 34008 - DNA, 24 bp, Homo sapiens
cgccccccactgctcgccctggtg

SEQ ID NO: 34009 - DNA, 24 bp, Homo sapiens
gattgggagactgaggcaggcgcg

SEQ ID NO: 34010 - DNA, 24 bp, Homo sapiens
ccacctccaggcagttttcctgaa

SEQ ID NO: 34011 - DNA, 24 bp, Homo sapiens
gcacctggctgggacctgccgcag

SEQ ID NO: 34012 - DNA, 24 bp, Homo sapiens
acctttaagaaagaatgtgtggag

SEQ ID NO: 34013 - DNA, 24 bp, Homo sapiens
cacctttaagaaagaatgtgtgga

SEQ ID NO: 34014 - DNA, 24 bp, Homo sapiens
gcacctttaagaaagaatgtgtgg

SEQ ID NO: 34015 - DNA, 24 bp, Homo sapiens
gtgagtgctgcgggacggatggtg

SEQ ID NO: 34016 - DNA, 24 bp, Homo sapiens
gagcggcgacacactaggagtccc

SEQ ID NO: 34017 - DNA, 24 bp, Homo sapiens
gagccagcccctcccctacccgga

SEQ ID NO: 34018 - DNA, 24 bp, Homo sapiens
caagtaatttggtgagaggtgcct

SEQ ID NO: 34019 - DNA, 24 bp, Homo sapiens
tggtaggctaagaaagtaacaaca

SEQ ID NO: 34020 - DNA, 24 bp, Homo sapiens
taatcccagcacttttggaggccg

SEQ ID NO: 34021 - DNA, 24 bp, Homo sapiens
ctgtccaggtagcctctgttttca

SEQ ID NO: 34022 - DNA, 24 bp, Homo sapiens
gttgaagttgcttttaaacacagc

SEQ ID NO: 34023 - DNA, 24 bp, Homo sapiens
tgaaaactttctaacttatatctc

SEQ ID NO: 34024 - DNA, 24 bp, Homo sapiens
aagaaatgatggaagaggttgatc

SEQ ID NO: 34025 - DNA, 24 bp, Homo sapiens
gaagaaatgatggaagaggttgat

SEQ ID NO: 34026 - DNA, 24 bp, Homo sapiens
ggaagaaatgatggaagaggttga

SEQ ID NO: 34027 - DNA, 24 bp, Homo sapiens
tccacctacagtgtctccgcatcc

SEQ ID NO: 34028 - DNA, 24 bp, Homo sapiens
ctccacctacagtgtctccgcatc

SEQ ID NO: 34029 - DNA, 24 bp, Homo sapiens
gctccacctacagtgtctccgcat

SEQ ID NO: 34030 - DNA, 24 bp, Homo sapiens
ttcctgaccatgctgcttaccacc

SEQ ID NO: 34031 - DNA, 24 bp, Homo sapiens
cttcagcaccaccagccacctcaa

SEQ ID NO: 34032 - DNA, 24 bp, Homo sapiens
cctctgccatcctgccactgcctg

SEQ ID NO: 34033 - DNA, 24 bp, Homo sapiens
ctgatggctgtgcagttgctggac

SEQ ID NO: 34034 - DNA, 24 bp, Homo sapiens
tctcactcatcatcctgctcaccg

SEQ ID NO: 34035 - DNA, 24 bp, Homo sapiens
aaccaggaggagcggctgcccgaa

SEQ ID NO: 34036 - DNA, 24 bp, Homo sapiens
cttcagcaccaccagccacctcaa

SEQ ID NO: 34037 - DNA, 24 bp, Homo sapiens
ttcctgaccatgctgcttaccacc

SEQ ID NO: 34038 - DNA, 24 bp, Homo sapiens
ccgatgaccaagagcagtctcaag

SEQ ID NO: 34039 - DNA, 24 bp, Homo sapiens
gagtagggcaggcaatggcgtcca

SEQ ID NO: 34040 - DNA, 24 bp, Homo sapiens
cgagtagggcaggcaatggcgtcc

SEQ ID NO: 34041 - DNA, 24 bp, Homo sapiens
tcgagtagggcaggcaatggcgtc

SEQ ID NO: 34042 - DNA, 24 bp, Homo sapiens
aagccattctcctgcctcgccttc

SEQ ID NO: 34043 - DNA, 24 bp, Homo sapiens
cagtgctggagaatgtaatggaga

SEQ ID NO: 34044 - DNA, 24 bp, Homo sapiens
tgcctatccctgagttccagtcta

SEQ ID NO: 34045 - DNA, 24 bp, Homo sapiens
tagaactgaagaacaatgcctcga

SEQ ID NO: 34046 - DNA, 24 bp, Homo sapiens
ttagaactgaagaacaatgcctcg

SEQ ID NO: 34047 - DNA, 24 bp, Homo sapiens
gttagaactgaagaacaatgcctc

SEQ ID NO: 34048 - DNA, 24 bp, Homo sapiens
atgttatacaagtaagtattttct

SEQ ID NO: 34049 - DNA, 24 bp, Homo sapiens
aatgttatacaagtaagtattttc

SEQ ID NO: 34050 - DNA, 24 bp, Homo sapiens
taatgttatacaagtaagtatttt

SEQ ID NO: 34051 - DNA, 24 bp, Homo sapiens
gtgcagctaatctttgtaataaaa

SEQ ID NO: 34052 - DNA, 24 bp, Homo sapiens
ggtgcagctaatctttgtaataaa

SEQ ID NO: 34053 - DNA, 24 bp, Homo sapiens
tggtgcagctaatctttgtaataa

SEQ ID NO: 34054 - DNA, 24 bp, Homo sapiens
aaatgattgtggagaagaatttgg

SEQ ID NO: 34055 - DNA, 24 bp, Homo sapiens
caaatgattgtggagaagaatttg

SEQ ID NO: 34056 - DNA, 24 bp, Homo sapiens
tcaaatgattgtggagaagaattt

SEQ ID NO: 34057 - DNA, 24 bp, Homo sapiens
ggtgcaggacagtggaacagcttg

SEQ ID NO: 34058 - DNA, 24 bp, Homo sapiens
ctttggtttcagtcccgcatggca

SEQ ID NO: 34059 - DNA, 24 bp, Homo sapiens
gagagctgactgcctggttccaag

SEQ ID NO: 34060 - DNA, 24 bp, Homo sapiens
ttgccaacgaggagaagaacaagc

SEQ ID NO: 34061 - DNA, 24 bp, Homo sapiens
cgcacaatctcatctacttcggct

SEQ ID NO: 34062 - DNA, 24 bp, Homo sapiens
gagccgcaagcagtccgtcttcag

SEQ ID NO: 34063 - DNA, 24 bp, Homo sapiens
gctcttcaagcacttcagccagcg

SEQ ID NO: 34064 - DNA, 24 bp, Homo sapiens
caacatgaacctggatcgcatcgg

SEQ ID NO: 34065 - DNA, 24 bp, Homo sapiens
cgtccgcctggattaccgcatatc

SEQ ID NO: 34066 - DNA, 24 bp, Homo sapiens
cctctgccttggtgagtggcaccc

SEQ ID NO: 34067 - DNA, 24 bp, Homo sapiens
ccctctgccttggtgagtggcacc

SEQ ID NO: 34068 - DNA, 24 bp, Homo sapiens
accctctgccttggtgagtggcac

SEQ ID NO: 34069 - DNA, 24 bp, Homo sapiens
attctcaaagagtaagtttatata

SEQ ID NO: 34070 - DNA, 24 bp, Homo sapiens
gattctcaaagagtaagtttatat

SEQ ID NO: 34071 - DNA, 24 bp, Homo sapiens
ggattctcaaagagtaagtttata

SEQ ID NO: 34072 - DNA, 24 bp, Homo sapiens
ttgctgtcgagataaatcaaacct

SEQ ID NO: 34073 - DNA, 24 bp, Homo sapiens
tttgctgtcgagataaatcaaacc

SEQ ID NO: 34074 - DNA, 24 bp, Homo sapiens
ttttgctgtcgagataaatcaaac

SEQ ID NO: 34075 - DNA, 24 bp, Homo sapiens
ggcaagcgtacttctgaagcaacc

SEQ ID NO: 34076 - DNA, 24 bp, Homo sapiens
gtggacgagacggaggattacaga

SEQ ID NO: 34077 - DNA, 24 bp, Homo sapiens
aggatctcagatgacaagtatggc

SEQ ID NO: 34078 - DNA, 24 bp, Homo sapiens
acagacacagccagccagccaggt

SEQ ID NO: 34079 - DNA, 24 bp, Homo sapiens
gacagacacagccagccagccagg

SEQ ID NO: 34080 - DNA, 24 bp, Homo sapiens
agacagacacagccagccagccag

SEQ ID NO: 34081 - DNA, 24 bp, Homo sapiens
cttttacaaaggataatcgagttc

SEQ ID NO: 34082 - DNA, 24 bp, Homo sapiens
acttttacaaaggataatcgagtt

SEQ ID NO: 34083 - DNA, 24 bp, Homo sapiens
cacttttacaaaggataatcgagt

SEQ ID NO: 34084 - DNA, 24 bp, Homo sapiens
tctttttctaggtaggatccatgc

SEQ ID NO: 34085 - DNA, 24 bp, Homo sapiens
ttctttttctaggtaggatccatg

SEQ ID NO: 34086 - DNA, 24 bp, Homo sapiens
cttctttttctaggtaggatccat

SEQ ID NO: 34087 - DNA, 24 bp, Homo sapiens
tgaggaagagagcgtggacccaaa

SEQ ID NO: 34088 - DNA, 24 bp, Homo sapiens
tccgcagtcaagcaattcatcagc

SEQ ID NO: 34089 - DNA, 24 bp, Homo sapiens
ggatcacctgactgacatcacctt

SEQ ID NO: 34090 - DNA, 24 bp, Homo sapiens
ccaacggaggaggctactaccact

SEQ ID NO: 34091 - DNA, 23 bp, Homo sapiens
ggcacactcaccaacaagatggc

SEQ ID NO: 34092 - DNA, 23 bp, Homo sapiens
ccgctacgacatggaccgctttg

SEQ ID NO: 34093 - DNA, 25 bp, Homo sapiens
tgtactaccaaatatctagaggcag

SEQ ID NO: 34094 - DNA, 23 bp, Homo sapiens
aaaatcagtgaaaagcctcaaaa

SEQ ID NO: 34095 - DNA, 24 bp, Homo sapiens
aatgtgggctgggctgaacctgta

SEQ ID NO: 34096 - DNA, 24 bp, Homo sapiens
caatgtgggctgggctgaacctgt

SEQ ID NO: 34097 - DNA, 24 bp, Homo sapiens
tcaatgtgggctgggctgaacctg

SEQ ID NO: 34098 - DNA, 25 bp, Homo sapiens
gcaggtcccaattagccagaggaag

SEQ ID NO: 34099 - DNA, 23 bp, Homo sapiens
gagcaagggcagcagtgggcagg

SEQ ID NO: 34100 - DNA, 24 bp, Homo sapiens
aaagatgaacatccaagggctggc

SEQ ID NO: 34101 - DNA, 24 bp, Homo sapiens
ctcggacccagggctccttcagtg

SEQ ID NO: 34102 - DNA, 24 bp, Homo sapiens
actcggacccagggctccttcagt

SEQ ID NO: 34103 - DNA, 24 bp, Homo sapiens
gactcggacccagggctccttcag

SEQ ID NO: 34104 - DNA, 24 bp, Homo sapiens
actacaattagctgttctgaagcc

SEQ ID NO: 34105 - DNA, 24 bp, Homo sapiens
cactacaattagctgttctgaagc

SEQ ID NO: 34106 - DNA, 24 bp, Homo sapiens
acactacaattagctgttctgaag

SEQ ID NO: 34107 - DNA, 23 bp, Homo sapiens
ccgtggctgctgtgctgctcatg

SEQ ID NO: 34108 - DNA, 25 bp, Homo sapiens
gatctgtgaggtctacctccctggg

SEQ ID NO: 34109 - DNA, 23 bp, Homo sapiens
acaccctgtatcgaccggagcag

SEQ ID NO: 34110 - DNA, 24 bp, Homo sapiens
ctggggcagccgggctatgacggg

SEQ ID NO: 34111 - DNA, 24 bp, Homo sapiens
ctgcaggtgtggtggcaggcaggg

SEQ ID NO: 34112 - DNA, 24 bp, Homo sapiens
aggaaataatatgttaaattgaaa

SEQ ID NO: 34113 - DNA, 24 bp, Homo sapiens
aaggaaataatatgttaaattgaa

SEQ ID NO: 34114 - DNA, 24 bp, Homo sapiens
taaggaaataatatgttaaattga

SEQ ID NO: 34115 - DNA, 24 bp, Homo sapiens
gcaataaaaaggaattagaaaata

SEQ ID NO: 34116 - DNA, 24 bp, Homo sapiens
tgcaataaaaaggaattagaaaat

SEQ ID NO: 34117 - DNA, 24 bp, Homo sapiens
atgcaataaaaaggaattagaaaa

SEQ ID NO: 34118 - DNA, 23 bp, Homo sapiens
aggcaggacgacagcagcagcag

SEQ ID NO: 34119 - DNA, 23 bp, Homo sapiens
tctgctagagtccatccgccaag

SEQ ID NO: 34120 - DNA, 25 bp, Homo sapiens
ggagaagaagcagcagaaggagcag

SEQ ID NO: 34121 - DNA, 24 bp, Homo sapiens
ctcctcaggcaagctcacctactt

SEQ ID NO: 34122 - DNA, 25 bp, Homo sapiens
aatgtactactccttggcaatggca

SEQ ID NO: 34123 - DNA, 25 bp, Homo sapiens
gctctggctggagtgctgacaatag

SEQ ID NO: 34124 - DNA, 25 bp, Homo sapiens
cgcctatgtgctcaattactaccgc

SEQ ID NO: 34125 - DNA, 23 bp, Homo sapiens
aggcgactgcttgaccacggcgg

SEQ ID NO: 34126 - DNA, 23 bp, Homo sapiens
agccgtcgccgcctccactgtcg

SEQ ID NO: 34127 - DNA, 24 bp, Homo sapiens
ttgttgcccaggctgaagtgcaat

SEQ ID NO: 34128 - DNA, 24 bp, Homo sapiens
cttgttgcccaggctgaagtgcaa

SEQ ID NO: 34129 - DNA, 24 bp, Homo sapiens
tcttgttgcccaggctgaagtgca

SEQ ID NO: 34130 - DNA, 24 bp, Homo sapiens
attaaaagcaggtaaactttgtaa

SEQ ID NO: 34131 - DNA, 24 bp, Homo sapiens
cattaaaagcaggtaaactttgta

SEQ ID NO: 34132 - DNA, 24 bp, Homo sapiens
acattaaaagcaggtaaactttgt

SEQ ID NO: 34133 - DNA, 24 bp, Homo sapiens
tgcaaaacaaggtagacattaacc

SEQ ID NO: 34134 - DNA, 24 bp, Homo sapiens
gtgcaaaacaaggtagacattaac

SEQ ID NO: 34135 - DNA, 24 bp, Homo sapiens
ggtgcaaaacaaggtagacattaa

SEQ ID NO: 34136 - DNA, 25 bp, Homo sapiens
atggtcttctgaagcctacctgtgt

SEQ ID NO: 34137 - DNA, 25 bp, Homo sapiens
agaatgatgtgtgtttacccaaggc

SEQ ID NO: 34138 - DNA, 25 bp, Homo sapiens
gcactgtggttcacgcctgtaatcc

SEQ ID NO: 34139 - DNA, 25 bp, Homo sapiens
ttctgaagcctacctgtgtaaggaa

SEQ ID NO: 34140 - DNA, 25 bp, Homo sapiens
gcactgtggttcacgcctgtaatcc

SEQ ID NO: 34141 - DNA, 23 bp, Homo sapiens
atggtggtgggtgcctctagtcc

SEQ ID NO: 34142 - DNA, 25 bp, Homo sapiens
agaatgatgtgtgtttacccaaggc

SEQ ID NO: 34143 - DNA, 25 bp, Homo sapiens
gcactgtggttcacgcctgtaatcc

SEQ ID NO: 34144 - DNA, 23 bp, Homo sapiens
atggtggtgggtgcctctagtcc

SEQ ID NO: 34145 - DNA, 23 bp, Homo sapiens
acactgtggcaggagcacttcaa

SEQ ID NO: 34146 - DNA, 25 bp, Homo sapiens
gccaacttccagacagactctcagg

SEQ ID NO: 34147 - DNA, 25 bp, Homo sapiens
agactttgacagatggcacatgcga

SEQ ID NO: 34148 - DNA, 25 bp, Homo sapiens
tgtcactggcagaactacaggaacc

SEQ ID NO: 34149 - DNA, 23 bp, Homo sapiens
ccaggcacttgagcggaaagagc

SEQ ID NO: 34150 - DNA, 23 bp, Homo sapiens
gaagtggctgctggaatggtgct

SEQ ID NO: 34151 - DNA, 24 bp, Homo sapiens
agaaaaagcaggttcgtgttttat

SEQ ID NO: 34152 - DNA, 24 bp, Homo sapiens
cagaaaaagcaggttcgtgtttta

SEQ ID NO: 34153 - DNA, 24 bp, Homo sapiens
tcagaaaaagcaggttcgtgtttt

SEQ ID NO: 34154 - DNA, 25 bp, Homo sapiens
ccgctgtatgtcctcaagtacctga

SEQ ID NO: 34155 - DNA, 23 bp, Homo sapiens
accttgtgcccttgccagtgaac

SEQ ID NO: 34156 - DNA, 23 bp, Homo sapiens
ctaccaagcaagcaccacaagaa

SEQ ID NO: 34157 - DNA, 24 bp, Homo sapiens
caactcgctggctcatgcaggtaa

SEQ ID NO: 34158 - DNA, 23 bp, Homo sapiens
tggtggtggtgtcctcgctgctc

SEQ ID NO: 34159 - DNA, 23 bp, Homo sapiens
tcgttctccactccctactcggc

SEQ ID NO: 34160 - DNA, 24 bp, Homo sapiens
cttcgacccagccagcctccaggg

SEQ ID NO: 34161 - DNA, 24 bp, Homo sapiens
acttcgacccagccagcctccagg

SEQ ID NO: 34162 - DNA, 24 bp, Homo sapiens
aacttcgacccagccagcctccag

SEQ ID NO: 34163 - DNA, 24 bp, Homo sapiens
atttttaaaagaaatcatatggta

SEQ ID NO: 34164 - DNA, 24 bp, Homo sapiens
tatttttaaaagaaatcatatggt

SEQ ID NO: 34165 - DNA, 24 bp, Homo sapiens
ttatttttaaaagaaatcatatgg

SEQ ID NO: 34166 - DNA, 25 bp, Homo sapiens
gagaggagtggtcttggctgtcaga

SEQ ID NO: 34167 - DNA, 25 bp, Homo sapiens
ctgaagtggcatggagattgaggtc

SEQ ID NO: 34168 - DNA, 25 bp, Homo sapiens
gagggctgacatttggagagatggg

SEQ ID NO: 34169 - DNA, 23 bp, Homo sapiens
gctggtggtggatgccgtactgg

SEQ ID NO: 34170 - DNA, 23 bp, Homo sapiens
ccagtgcgagaagatggacatcc

SEQ ID NO: 34171 - DNA, 23 bp, Homo sapiens
cacacgctcgctggacctgctgc

SEQ ID NO: 34172 - DNA, 24 bp, Homo sapiens
cttgtgaacaggactttccaattc

SEQ ID NO: 34173 - DNA, 24 bp, Homo sapiens
tcttgtgaacaggactttccaatt

SEQ ID NO: 34174 - DNA, 24 bp, Homo sapiens
ttcttgtgaacaggactttccaat

SEQ ID NO: 34175 - DNA, 25 bp, Homo sapiens
gcaggaggatcacgaggtcaagaga

SEQ ID NO: 34176 - DNA, 23 bp, Homo sapiens
caggagaactggctcaggtctgc

SEQ ID NO: 34177 - DNA, 23 bp, Homo sapiens
gtgaggataccgaagaccgatgg

SEQ ID NO: 34178 - DNA, 23 bp, Homo sapiens
atgggaatgcctggacgctgatc

SEQ ID NO: 34179 - DNA, 25 bp, Homo sapiens
acaaagaagtgatgttggagaattt

SEQ ID NO: 34180 - DNA, 23 bp, Homo sapiens
gatgtttccatagacttctctca

SEQ ID NO: 34181 - DNA, 23 bp, Homo sapiens
ccaagtgccttctctgcctgtca

SEQ ID NO: 34182 - DNA, 23 bp, Homo sapiens
accctacctgccaacctctccac

SEQ ID NO: 34183 - DNA, 23 bp, Homo sapiens
ccgctgccctttgcttactggaa

SEQ ID NO: 34184 - DNA, 24 bp, Homo sapiens
accccgctcagcagggctatgtga

SEQ ID NO: 34185 - DNA, 24 bp, Homo sapiens
gaccccgctcagcagggctatgtg

SEQ ID NO: 34186 - DNA, 24 bp, Homo sapiens
ggaccccgctcagcagggctatgt

SEQ ID NO: 34187 - DNA, 24 bp, Homo sapiens
cgactggaccgattatgaagactt

SEQ ID NO: 34188 - DNA, 25 bp, Homo sapiens
taacgaaacatcaccagccgaaggg

SEQ ID NO: 34189 - DNA, 23 bp, Homo sapiens
gaccatcaccaagactgcctgcc

SEQ ID NO: 34190 - DNA, 23 bp, Homo sapiens
cccgtctcagcctcccaaagtgc

SEQ ID NO: 34191 - DNA, 25 bp, Homo sapiens
gcctagcacctaataaacctccagt

SEQ ID NO: 34192 - DNA, 25 bp, Homo sapiens
ctaagtcaccattcaagctccttcc

SEQ ID NO: 34193 - DNA, 24 bp, Homo sapiens
gcctcgtgctaggtcttctgactc

SEQ ID NO: 34194 - DNA, 23 bp, Homo sapiens
gatccacccacctcagcctccca

SEQ ID NO: 34195 - DNA, 23 bp, Homo sapiens
tctccctgtgccagagctgcctc

SEQ ID NO: 34196 - DNA, 24 bp, Homo sapiens
ggcattctggagactctgattggc

SEQ ID NO: 34197 - DNA, 24 bp, Homo sapiens
tctcagaacccagtgacctctcct

SEQ ID NO: 34198 - DNA, 24 bp, Homo sapiens
gatgggctgactggctgggcagat

SEQ ID NO: 34199 - DNA, 23 bp, Homo sapiens
ggagaggtcggagctggtgaacg

SEQ ID NO: 34200 - DNA, 24 bp, Homo sapiens
aaggctgagaccatccaggctctt

SEQ ID NO: 34201 - DNA, 24 bp, Homo sapiens
ggctgtgaacaccaatgtctctgt

SEQ ID NO: 34202 - DNA, 24 bp, Homo sapiens
aggaatactctctggggcggatgg

SEQ ID NO: 34203 - DNA, 23 bp, Homo sapiens
ctgagccaccacgaccccatcat

SEQ ID NO: 34204 - DNA, 24 bp, Homo sapiens
ctgtccattcgaggcctggtcatc

SEQ ID NO: 34205 - DNA, 24 bp, Homo sapiens
gtgcggtctatgtggagatgctgc

SEQ ID NO: 34206 - DNA, 25 bp, Homo sapiens
tccacaacctcaaggctgtcttcaa

SEQ ID NO: 34207 - DNA, 23 bp, Homo sapiens
catggatgggatgctggtggtgg

SEQ ID NO: 34208 - DNA, 24 bp, Homo sapiens
ttattacatagaactgaaatgttg

SEQ ID NO: 34209 - DNA, 24 bp, Homo sapiens
tttattacatagaactgaaatgtt

SEQ ID NO: 34210 - DNA, 24 bp, Homo sapiens
gtttattacatagaactgaaatgt

SEQ ID NO: 34211 - DNA, 24 bp, Homo sapiens
aacttgaattggtagttatattca

SEQ ID NO: 34212 - DNA, 24 bp, Homo sapiens
gaacttgaattggtagttatattc

SEQ ID NO: 34213 - DNA, 24 bp, Homo sapiens
ggaacttgaattggtagttatatt

SEQ ID NO: 34214 - DNA, 24 bp, Homo sapiens
cttgaggacagcggcagtggcgag

SEQ ID NO: 34215 - DNA, 24 bp, Homo sapiens
ttgtgtcaggaaccgttctgcctt

SEQ ID NO: 34216 - DNA, 24 bp, Homo sapiens
cagccgtagcacctctgtgtcttc

SEQ ID NO: 34217 - DNA, 24 bp, Homo sapiens
agcaaatggagaagtgggaggtga

SEQ ID NO: 34218 - DNA, 24 bp, Homo sapiens
agcagatgatggatgtctctcgga

SEQ ID NO: 34219 - DNA, 24 bp, Homo sapiens
agagcctccgtgtccactaaatgt

SEQ ID NO: 34220 - DNA, 23 bp, Homo sapiens
gggaccaaatcactggaaggcag

SEQ ID NO: 34221 - DNA, 23 bp, Homo sapiens
gtccttgcgggcaccacagagcg

SEQ ID NO: 34222 - DNA, 23 bp, Homo sapiens
tcaccaccccctgccccgccttg

SEQ ID NO: 34223 - DNA, 24 bp, Homo sapiens
atctaggacaggtaattttgaaaa

SEQ ID NO: 34224 - DNA, 24 bp, Homo sapiens
aatctaggacaggtaattttgaaa

SEQ ID NO: 34225 - DNA, 24 bp, Homo sapiens
aaatctaggacaggtaattttgaa

SEQ ID NO: 34226 - DNA, 24 bp, Homo sapiens
agaaaaaaaagatcttcagctctg

SEQ ID NO: 34227 - DNA, 24 bp, Homo sapiens
aagaaaaaaaagatcttcagctct

SEQ ID NO: 34228 - DNA, 24 bp, Homo sapiens
aaagaaaaaaaagatcttcagctc

SEQ ID NO: 34229 - DNA, 24 bp, Homo sapiens
tgatgtaacaagtaagtaattttc

SEQ ID NO: 34230 - DNA, 24 bp, Homo sapiens
ctgatgtaacaagtaagtaatttt

SEQ ID NO: 34231 - DNA, 24 bp, Homo sapiens
actgatgtaacaagtaagtaattt

SEQ ID NO: 34232 - DNA, 25 bp, Homo sapiens
tggaatatgaagggcacgctctgtc

SEQ ID NO: 34233 - DNA, 23 bp, Homo sapiens
ggcaggctttccaaacagaccga

SEQ ID NO: 34234 - DNA, 25 bp, Homo sapiens
aggtatcacactcttcatctgcttg

SEQ ID NO: 34235 - DNA, 25 bp, Homo sapiens
tggaacggaagatgagtttgctgaa

SEQ ID NO: 34236 - DNA, 25 bp, Homo sapiens
aacagcacagccaagacttcatcaa

SEQ ID NO: 34237 - DNA, 24 bp, Homo sapiens
gctatctctcagagaagctggagc

SEQ ID NO: 34238 - DNA, 24 bp, Homo sapiens
tctctaagcagaaatgaagaatgt

SEQ ID NO: 34239 - DNA, 24 bp, Homo sapiens
ttctctaagcagaaatgaagaatg

SEQ ID NO: 34240 - DNA, 24 bp, Homo sapiens
tttctctaagcagaaatgaagaat

SEQ ID NO: 34241 - DNA, 24 bp, Homo sapiens
aattttgatagcattgtaaagaaa

SEQ ID NO: 34242 - DNA, 24 bp, Homo sapiens
taattttgatagcattgtaaagaa

SEQ ID NO: 34243 - DNA, 24 bp, Homo sapiens
ataattttgatagcattgtaaaga

SEQ ID NO: 34244 - DNA, 24 bp, Homo sapiens
aaagaaaaaagcatatcttcattg

SEQ ID NO: 34245 - DNA, 24 bp, Homo sapiens
gaaagaaaaaagcatatcttcatt

SEQ ID NO: 34246 - DNA, 24 bp, Homo sapiens
tgaaagaaaaaagcatatcttcat

SEQ ID NO: 34247 - DNA, 24 bp, Homo sapiens
atccttcacaggtggaatttttgt

SEQ ID NO: 34248 - DNA, 24 bp, Homo sapiens
tatccttcacaggtggaatttttg

SEQ ID NO: 34249 - DNA, 24 bp, Homo sapiens
ttatccttcacaggtggaattttt

SEQ ID NO: 34250 - DNA, 25 bp, Homo sapiens
aagtggtttctgttcttcccagggc

SEQ ID NO: 34251 - DNA, 23 bp, Homo sapiens
gtgctggtctgtggctgcctgtc

SEQ ID NO: 34252 - DNA, 25 bp, Homo sapiens
aatggaactgaagggagggaagagc

SEQ ID NO: 34253 - DNA, 23 bp, Homo sapiens
cagtcgcacaacctcggctcact

SEQ ID NO: 34254 - DNA, 23 bp, Homo sapiens
tgtcttgctgtgtcactcaggct

SEQ ID NO: 34255 - DNA, 23 bp, Homo sapiens
gtgatctcggacgacagcggctc

SEQ ID NO: 34256 - DNA, 24 bp, Homo sapiens
tgaacaagaagcatggcaccagca

SEQ ID NO: 34257 - DNA, 23 bp, Homo sapiens
cagtcgcacaacctcggctcact

SEQ ID NO: 34258 - DNA, 23 bp, Homo sapiens
gtgatctcggacgacagcggctc

SEQ ID NO: 34259 - DNA, 25 bp, Homo sapiens
tggctcatcacaacaaggaaggctg

SEQ ID NO: 34260 - DNA, 24 bp, Homo sapiens
caacttgattggattgaaggatgc

SEQ ID NO: 34261 - DNA, 25 bp, Homo sapiens
ttgggaaagacttggagggtttggc

SEQ ID NO: 34262 - DNA, 23 bp, Homo sapiens
ctgctgtgctggtcctgctggtg

SEQ ID NO: 34263 - DNA, 25 bp, Homo sapiens
caccaagacaatccgcaacaacagc

SEQ ID NO: 34264 - DNA, 24 bp, Homo sapiens
caactagcgatggacattggcacc

SEQ ID NO: 34265 - DNA, 24 bp, Homo sapiens
catatgaggaggtaggaccttttt

SEQ ID NO: 34266 - DNA, 24 bp, Homo sapiens
gcatatgaggaggtaggacctttt

SEQ ID NO: 34267 - DNA, 24 bp, Homo sapiens
cgcatatgaggaggtaggaccttt

SEQ ID NO: 34268 - DNA, 23 bp, Homo sapiens
cctgccgccgctgcctctgcctc

SEQ ID NO: 34269 - DNA, 23 bp, Homo sapiens
tccgtgtcctgccagcggctgcc

SEQ ID NO: 34270 - DNA, 23 bp, Homo sapiens
caccaggagtacttctccccgcc

SEQ ID NO: 34271 - DNA, 23 bp, Homo sapiens
gccctggacgaagtgacagccat

SEQ ID NO: 34272 - DNA, 23 bp, Homo sapiens
gtggtggtggacgtggacctgac

SEQ ID NO: 34273 - DNA, 23 bp, Homo sapiens
cgccaagaccttccgcctgaagc

SEQ ID NO: 34274 - DNA, 24 bp, Homo sapiens
ggccccacaagggtcttcctgcac

SEQ ID NO: 34275 - DNA, 24 bp, Homo sapiens
cggccccacaagggtcttcctgca

SEQ ID NO: 34276 - DNA, 24 bp, Homo sapiens
tcggccccacaagggtcttcctgc

SEQ ID NO: 34277 - DNA, 25 bp, Homo sapiens
cttgtttgcttcaggctgtctgctt

SEQ ID NO: 34278 - DNA, 23 bp, Homo sapiens
gtgtccaggtgtgagcatgagcg

SEQ ID NO: 34279 - DNA, 25 bp, Homo sapiens
tctgtttctggccatggaggaagag

SEQ ID NO: 34280 - DNA, 23 bp, Homo sapiens
agcctctacgatcctgtgtgcgg

SEQ ID NO: 34281 - DNA, 23 bp, Homo sapiens
ctgtgaagaacgggcaggcagcg

SEQ ID NO: 34282 - DNA, 23 bp, Homo sapiens
cctgtaccctcgggcgggagatc

SEQ ID NO: 34283 - DNA, 24 bp, Homo sapiens
ctgttgtccagactggagtgcagc

SEQ ID NO: 34284 - DNA, 24 bp, Homo sapiens
tctgttgtccagactggagtgcag

SEQ ID NO: 34285 - DNA, 24 bp, Homo sapiens
ctctgttgtccagactggagtgca

SEQ ID NO: 34286 - DNA, 24 bp, Homo sapiens
gaagttagcatcagtgggactcgg

SEQ ID NO: 34287 - DNA, 24 bp, Homo sapiens
ggttccagctacagctcctccgtg

SEQ ID NO: 34288 - DNA, 24 bp, Homo sapiens
ctctgcccacaggaccccacaaca

SEQ ID NO: 34289 - DNA, 23 bp, Homo sapiens
cttcctgcgcatcgtctgcaaga

SEQ ID NO: 34290 - DNA, 23 bp, Homo sapiens
ctcggcgtgtacgtgggcagcgg

SEQ ID NO: 34291 - DNA, 23 bp, Homo sapiens
cgctgttgtggctgctggggctg

SEQ ID NO: 34292 - DNA, 24 bp, Homo sapiens
ttttggacaaagtgttgaatactg

SEQ ID NO: 34293 - DNA, 24 bp, Homo sapiens
cttttggacaaagtgttgaatact

SEQ ID NO: 34294 - DNA, 24 bp, Homo sapiens
acttttggacaaagtgttgaatac

SEQ ID NO: 34295 - DNA, 24 bp, Homo sapiens
agcaattctcctgtctcagcctcc

SEQ ID NO: 34296 - DNA, 24 bp, Homo sapiens
cagggttcgtggaaggttcaaggg

SEQ ID NO: 34297 - DNA, 24 bp, Homo sapiens
ataaaccgtcctcagaacccttgg

SEQ ID NO: 34298 - DNA, 23 bp, Homo sapiens
ggacaacaccaagaaggtctacg

SEQ ID NO: 34299 - DNA, 23 bp, Homo sapiens
tggcagggcatggaaggtgacta

SEQ ID NO: 34300 - DNA, 23 bp, Homo sapiens
gacacggttcgggacacctggac

SEQ ID NO: 34301 - DNA, 24 bp, Homo sapiens
tttatgtggagataacttttaagt

SEQ ID NO: 34302 - DNA, 24 bp, Homo sapiens
ttttatgtggagataacttttaag

SEQ ID NO: 34303 - DNA, 24 bp, Homo sapiens
tttttatgtggagataacttttaa

SEQ ID NO: 34304 - DNA, 24 bp, Homo sapiens
ttttttttttttttgacctgggag

SEQ ID NO: 34305 - DNA, 24 bp, Homo sapiens
tttttttttttttttgacctggga

SEQ ID NO: 34306 - DNA, 24 bp, Homo sapiens
ttttttttttttttttgacctggg

SEQ ID NO: 34307 - DNA, 24 bp, Homo sapiens
ataactatacatttttaaaatgca

SEQ ID NO: 34308 - DNA, 24 bp, Homo sapiens
aataactatacatttttaaaatgc

SEQ ID NO: 34309 - DNA, 24 bp, Homo sapiens
taataactatacatttttaaaatg

SEQ ID NO: 34310 - DNA, 24 bp, Homo sapiens
ccacagacatgactgagtcctcca

SEQ ID NO: 34311 - DNA, 24 bp, Homo sapiens
catgttcacactgggtgaaggaag

SEQ ID NO: 34312 - DNA, 24 bp, Homo sapiens
accctgctggacgccatcaccgat

SEQ ID NO: 34313 - DNA, 24 bp, Homo sapiens
ggctgctgctggagaagatgagta

SEQ ID NO: 34314 - DNA, 24 bp, Homo sapiens
gctgtttgtggtgcttctgctgcg

SEQ ID NO: 34315 - DNA, 24 bp, Homo sapiens
agcggcagcgaggatgtggtacag

SEQ ID NO: 34316 - DNA, 24 bp, Homo sapiens
ccgagcaggagcctgagaagccag

SEQ ID NO: 34317 - DNA, 24 bp, Homo sapiens
caccaccgtggacaggatgagtca

SEQ ID NO: 34318 - DNA, 24 bp, Homo sapiens
gccatacctgctccagttcctcac

SEQ ID NO: 34319 - DNA, 24 bp, Homo sapiens
gaagttaaaaggtaagagtttatt

SEQ ID NO: 34320 - DNA, 24 bp, Homo sapiens
agaagttaaaaggtaagagtttat

SEQ ID NO: 34321 - DNA, 24 bp, Homo sapiens
aagaagttaaaaggtaagagttta

SEQ ID NO: 34322 - DNA, 24 bp, Homo sapiens
tggcatttcccattctgctttcat

SEQ ID NO: 34323 - DNA, 25 bp, Homo sapiens
ttgaaatgatgatcttgtagttgct

SEQ ID NO: 34324 - DNA, 23 bp, Homo sapiens
tacccttccatgaaaggtaactc

SEQ ID NO: 34325 - DNA, 24 bp, Homo sapiens
gtggtggctgtggtggctcggaag

SEQ ID NO: 34326 - DNA, 24 bp, Homo sapiens
caccttcctctccattggctacgg

SEQ ID NO: 34327 - DNA, 24 bp, Homo sapiens
cgacaagcaggaagtgaccagcaa

SEQ ID NO: 34328 - DNA, 23 bp, Homo sapiens
ccgccgccgccgctgtttcgtcc

SEQ ID NO: 34329 - DNA, 23 bp, Homo sapiens
gcgtctgtcggaggaggtggcgg

SEQ ID NO: 34330 - DNA, 23 bp, Homo sapiens
tgcacgagatggactcagaggcg

SEQ ID NO: 34331 - DNA, 23 bp, Homo sapiens
actcaccaaagcggagaagcacg

SEQ ID NO: 34332 - DNA, 23 bp, Homo sapiens
gtggtggccgtggtggcccgaaa

SEQ ID NO: 34333 - DNA, 24 bp, Homo sapiens
ctgcagaggaggctggaccagtcc

SEQ ID NO: 34334 - DNA, 24 bp, Homo sapiens
gctgcagaggaggctggaccagtc

SEQ ID NO: 34335 - DNA, 24 bp, Homo sapiens
agctgcagaggaggctggaccagt

SEQ ID NO: 34336 - DNA, 23 bp, Homo sapiens
gctgtctgctgtctgctgtcctg

SEQ ID NO: 34337 - DNA, 25 bp, Homo sapiens
tctgtgaaacgctccagtggttaca

SEQ ID NO: 34338 - DNA, 24 bp, Homo sapiens
attaagcatacggtcacgagagtg

SEQ ID NO: 34339 - DNA, 24 bp, Homo sapiens
gaactcaacatgtaggggagggta

SEQ ID NO: 34340 - DNA, 24 bp, Homo sapiens
tgaactcaacatgtaggggagggt

SEQ ID NO: 34341 - DNA, 24 bp, Homo sapiens
atgaactcaacatgtaggggaggg

SEQ ID NO: 34342 - DNA, 24 bp, Homo sapiens
atctttaacagattatctctgtga

SEQ ID NO: 34343 - DNA, 24 bp, Homo sapiens
tatctttaacagattatctctgtg

SEQ ID NO: 34344 - DNA, 24 bp, Homo sapiens
tatctttaacagattatctctgtg

SEQ ID NO: 34345 - DNA, 24 bp, Homo sapiens
caaaatagaaggtaagaaccattt

SEQ ID NO: 34346 - DNA, 24 bp, Homo sapiens
gcaaaatagaaggtaagaaccatt

SEQ ID NO: 34347 - DNA, 24 bp, Homo sapiens
gcaaaatagaaggtaagaaccatt

SEQ ID NO: 34348 - DNA, 25 bp, Homo sapiens
gcactgtggttcacgcctgtaatcc

SEQ ID NO: 34349 - DNA, 25 bp, Homo sapiens
ttctgaagcctacctgtggaaggaa

SEQ ID NO: 34350 - DNA, 25 bp, Homo sapiens
atggtcttctgaagcctacctgtgt

SEQ ID NO: 34351 - DNA, 25 bp, Homo sapiens
atggtggcaacactgctgtcctatg

SEQ ID NO: 34352 - DNA, 25 bp, Homo sapiens
tccattatgccgtttatagtgagaa

SEQ ID NO: 34353 - DNA, 23 bp, Homo sapiens
atattctcatagatgctggtgct

SEQ ID NO: 34354 - DNA, 24 bp, Homo sapiens
gggcaggatgaaggcagagcgtgt

SEQ ID NO: 34355 - DNA, 24 bp, Homo sapiens
acattccagtgtgctgagaagggc

SEQ ID NO: 34356 - DNA, 24 bp, Homo sapiens
acaaccagagaacaggattcttcc

SEQ ID NO: 34357 - DNA, 24 bp, Homo sapiens
aatgttgaaagaaggagcaacaca

SEQ ID NO: 34358 - DNA, 24 bp, Homo sapiens
aaatgttgaaagaaggagcaacac

SEQ ID NO: 34359 - DNA, 24 bp, Homo sapiens
aaaatgttgaaagaaggagcaaca

SEQ ID NO: 34360 - DNA, 24 bp, Homo sapiens
aatgttgaaaggtaaaagcaaaat

SEQ ID NO: 34361 - DNA, 24 bp, Homo sapiens
aaatgttgaaaggtaaaagcaaaa

SEQ ID NO: 34362 - DNA, 24 bp, Homo sapiens
aaaatgttgaaaggtaaaagcaaa

SEQ ID NO: 34363 - DNA, 24 bp, Homo sapiens
cctgccgtgttgaagagttctgac

SEQ ID NO: 34364 - DNA, 24 bp, Homo sapiens
tctgagactgaatgcgggaggttc

SEQ ID NO: 34365 - DNA, 24 bp, Homo sapiens
gtgtgtggtgtcaaagtttcagga

SEQ ID NO: 34366 - DNA, 24 bp, Homo sapiens
agaccattaacaacagcagatcct

SEQ ID NO: 34367 - DNA, 24 bp, Homo sapiens
gcttatgggcagactggaagtgga

SEQ ID NO: 34368 - DNA, 24 bp, Homo sapiens
gcccaggacgttgatgctacaaac

SEQ ID NO: 34369 - DNA, 24 bp, Homo sapiens
accaggaagagctgctggtgtcca

SEQ ID NO: 34370 - DNA, 24 bp, Homo sapiens
gaccaggaagagctgctggtgtcc

SEQ ID NO: 34371 - DNA, 24 bp, Homo sapiens
ggaccaggaagagctgctggtgtc

SEQ ID NO: 34372 - DNA, 24 bp, Homo sapiens
ttcacaagcaggtaggagagttct

SEQ ID NO: 34373 - DNA, 24 bp, Homo sapiens
gttcacaagcaggtaggagagttc

SEQ ID NO: 34374 - DNA, 24 bp, Homo sapiens
agttcacaagcaggtaggagagtt

SEQ ID NO: 34375 - DNA, 24 bp, Homo sapiens
catggtgcttaggatggtggaggc

SEQ ID NO: 34376 - DNA, 24 bp, Homo sapiens
ggattacaggtgtgagccactgcg

SEQ ID NO: 34377 - DNA, 24 bp, Homo sapiens
ctggtggtcctacaggagaggctg

SEQ ID NO: 34378 - DNA, 24 bp, Homo sapiens
ggattacaggtgtgagccactgcg

SEQ ID NO: 34379 - DNA, 24 bp, Homo sapiens
gccatgctgctctcgaagtcctaa

SEQ ID NO: 34380 - DNA, 24 bp, Homo sapiens
aggaatattcctaaatataagagg

SEQ ID NO: 34381 - DNA, 24 bp, Homo sapiens
cgacaaaaaaaatgctgctgtaat

SEQ ID NO: 34382 - DNA, 24 bp, Homo sapiens
ccgacaaaaaaaatgctgctgtaa

SEQ ID NO: 34383 - DNA, 24 bp, Homo sapiens
tccgacaaaaaaaatgctgctgta

SEQ ID NO: 34384 - DNA, 24 bp, Homo sapiens
cccaaccatagggcctcatctttg

SEQ ID NO: 34385 - DNA, 24 bp, Homo sapiens
tcccaaccatagggcctcatcttt

SEQ ID NO: 34386 - DNA, 24 bp, Homo sapiens
atcccaaccatagggcctcatctt

SEQ ID NO: 34387 - DNA, 24 bp, Homo sapiens
aagcagaatgaatggatcacggaa

SEQ ID NO: 34388 - DNA, 24 bp, Homo sapiens
ggcgacgagattaggctgttatgc

SEQ ID NO: 34389 - DNA, 24 bp, Homo sapiens
ccgtctccaccatccatccatcca

SEQ ID NO: 34390 - DNA, 24 bp, Homo sapiens
agtaatatcagcaaaaccagaaat

SEQ ID NO: 34391 - DNA, 24 bp, Homo sapiens
aagtaatatcagcaaaaccagaaa

SEQ ID NO: 34392 - DNA, 24 bp, Homo sapiens
aaagtaatatcagcaaaaccagaa

SEQ ID NO: 34393 - DNA, 24 bp, Homo sapiens
ggggtgcactggtgccgtgcccct

SEQ ID NO: 34394 - DNA, 24 bp, Homo sapiens
tggggtgcactggtgccgtgcccc

SEQ ID NO: 34395 - DNA, 24 bp, Homo sapiens
gtggggtgcactggtgccgtgccc

SEQ ID NO: 34396 - DNA, 24 bp, Homo sapiens
aagcagcagtgaacagtcaggagc

SEQ ID NO: 34397 - DNA, 23 bp, Homo sapiens
acgtgaccagcattgccgtagac

SEQ ID NO: 34398 - DNA, 24 bp, Homo sapiens
gtgttgagcacatgcttactgggc

SEQ ID NO: 34399 - DNA, 24 bp, Homo sapiens
gcagagtaccggaacaattgccta

SEQ ID NO: 34400 - DNA, 24 bp, Homo sapiens
ggcagagtaccggaacaattgcct

SEQ ID NO: 34401 - DNA, 24 bp, Homo sapiens
aggcagagtaccggaacaattgcc

SEQ ID NO: 34402 - DNA, 24 bp, Homo sapiens
ggattatcgccaccatcacctctt

SEQ ID NO: 34403 - DNA, 24 bp, Homo sapiens
tgcgttaggatgctctgatctgac

SEQ ID NO: 34404 - DNA, 24 bp, Homo sapiens
gcagatgctcttgttgacttccag

SEQ ID NO: 34405 - DNA, 24 bp, Homo sapiens
gacctgccagattactccagccga

SEQ ID NO: 34406 - DNA, 24 bp, Homo sapiens
gcatcctatatcaacgcagagccc

SEQ ID NO: 34407 - DNA, 24 bp, Homo sapiens
agacaggtggtggctggattgaac

SEQ ID NO: 34408 - DNA, 24 bp, Homo sapiens
gcatcctatatcaacgcagagccc

SEQ ID NO: 34409 - DNA, 24 bp, Homo sapiens
agacaggtggtggctggattgaac

SEQ ID NO: 34410 - DNA, 24 bp, Homo sapiens
gctacgaattgcttccttctcaca

SEQ ID NO: 34411 - DNA, 24 bp, Homo sapiens
gtgagatgcagaccatttaatttg

SEQ ID NO: 34412 - DNA, 24 bp, Homo sapiens
ggtgagatgcagaccatttaattt

SEQ ID NO: 34413 - DNA, 24 bp, Homo sapiens
tggtgagatgcagaccatttaatt

SEQ ID NO: 34414 - DNA, 24 bp, Homo sapiens
aatatacagcagaaatctaaggat

SEQ ID NO: 34415 - DNA, 24 bp, Homo sapiens
aaatatacagcagaaatctaagga

SEQ ID NO: 34416 - DNA, 24 bp, Homo sapiens
aaaatatacagcagaaatctaagg

SEQ ID NO: 34417 - DNA, 24 bp, Homo sapiens
tatcccaacaggtactttaaaaga

SEQ ID NO: 34418 - DNA, 24 bp, Homo sapiens
atatcccaacaggtactttaaaag

SEQ ID NO: 34419 - DNA, 24 bp, Homo sapiens
gatatcccaacaggtactttaaaa

SEQ ID NO: 34420 - DNA, 24 bp, Homo sapiens
ccagttcctgctgttcctgtccag

SEQ ID NO: 34421 - DNA, 24 bp, Homo sapiens
cttcaggaccagctcagagatgcc

SEQ ID NO: 34422 - DNA, 24 bp, Homo sapiens
agaacttgcgtgcttgtgtcctgg

SEQ ID NO: 34423 - DNA, 24 bp, Homo sapiens
agaacttgcgtgcttgtgtcctgg

SEQ ID NO: 34424 - DNA, 24 bp, Homo sapiens
cttcaggaccagctcagagatgcc

SEQ ID NO: 34425 - DNA, 24 bp, Homo sapiens
aggtggaattgcaggaagaacgga

SEQ ID NO: 34426 - DNA, 23 bp, Homo sapiens
tcgactacagctcgtggactcgg

SEQ ID NO: 34427 - DNA, 23 bp, Homo sapiens
caaacagaggcaggaagggcagg

SEQ ID NO: 34428 - DNA, 23 bp, Homo sapiens
tgactctaaccacagcctcctgc

SEQ ID NO: 34429 - DNA, 25 bp, Homo sapiens
attacggtgactctaaccacagcct

SEQ ID NO: 34430 - DNA, 23 bp, Homo sapiens
aggatggacggacagaggttgcg

SEQ ID NO: 34431 - DNA, 23 bp, Homo sapiens
ccctgttctgccgcttgacccac

SEQ ID NO: 34432 - DNA, 24 bp, Homo sapiens
ccttgagcctgaaatatgaccacc

SEQ ID NO: 34433 - DNA, 24 bp, Homo sapiens
gccttgagcctgaaatatgaccac

SEQ ID NO: 34434 - DNA, 24 bp, Homo sapiens
tgccttgagcctgaaatatgacca

SEQ ID NO: 34435 - DNA, 24 bp, Homo sapiens
ccgaattgtgattcaggcaagagc

SEQ ID NO: 34436 - DNA, 24 bp, Homo sapiens
attgctggagatagtaccatgtgc

SEQ ID NO: 34437 - DNA, 24 bp, Homo sapiens
ggagacttgtggaactgctgatgc

SEQ ID NO: 34438 - DNA, 24 bp, Homo sapiens
tgaagttatcagcacaccaggagt

SEQ ID NO: 34439 - DNA, 24 bp, Homo sapiens
ccgaattgtgattcaggcaagagc

SEQ ID NO: 34440 - DNA, 24 bp, Homo sapiens
agtaacatggagatggcaccaggt

SEQ ID NO: 34441 - DNA, 24 bp, Homo sapiens
ttcagtgtctgaaatcatgaccac

SEQ ID NO: 34442 - DNA, 24 bp, Homo sapiens
attcagtgtctgaaatcatgacca

SEQ ID NO: 34443 - DNA, 24 bp, Homo sapiens
gattcagtgtctgaaatcatgacc

SEQ ID NO: 34444 - DNA, 24 bp, Homo sapiens
aacagtatctcgcttctggctcat

SEQ ID NO: 34445 - DNA, 24 bp, Homo sapiens
ggcttttcccctctgtgactggca

SEQ ID NO: 34446 - DNA, 24 bp, Homo sapiens
tctcctgctagtactgtgccgctt

SEQ ID NO: 34447 - DNA, 24 bp, Homo sapiens
cctcttttagagtaagtactttat

SEQ ID NO: 34448 - DNA, 24 bp, Homo sapiens
acctcttttagagtaagtacttta

SEQ ID NO: 34449 - DNA, 24 bp, Homo sapiens
cacctcttttagagtaagtacttt

SEQ ID NO: 34450 - DNA, 23 bp, Homo sapiens
agttccgccgggtttcactgtcc

SEQ ID NO: 34451 - DNA, 23 bp, Homo sapiens
agattgcaaattcgcggtgactc

SEQ ID NO: 34452 - DNA, 23 bp, Homo sapiens
ggcagcagcagcagacgctggcg

SEQ ID NO: 34453 - DNA, 24 bp, Homo sapiens
ttcatgagaaggtgattgcagctc

SEQ ID NO: 34454 - DNA, 24 bp, Homo sapiens
tttcatgagaaggtgattgcagct

SEQ ID NO: 34455 - DNA, 24 bp, Homo sapiens
atttcatgagaaggtgattgcagc

SEQ ID NO: 34456 - DNA, 24 bp, Homo sapiens
tttttccccagatctcttacatga

SEQ ID NO: 34457 - DNA, 24 bp, Homo sapiens
atttttccccagatctcttacatg

SEQ ID NO: 34458 - DNA, 24 bp, Homo sapiens
aatttttccccagatctcttacat

SEQ ID NO: 34459 - DNA, 24 bp, Homo sapiens
attacgacaagttaaaagacaaga

SEQ ID NO: 34460 - DNA, 24 bp, Homo sapiens
aattacgacaagttaaaagacaag

SEQ ID NO: 34461 - DNA, 24 bp, Homo sapiens
gaattacgacaagttaaaagacaa

SEQ ID NO: 34462 - DNA, 24 bp, Homo sapiens
tttttgtacagaagcacttcccct

SEQ ID NO: 34463 - DNA, 24 bp, Homo sapiens
ctttttgtacagaagcacttcccc

SEQ ID NO: 34464 - DNA, 24 bp, Homo sapiens
cctttttgtacagaagcacttccc

SEQ ID NO: 34465 - DNA, 24 bp, Homo sapiens
cttgattttagatcaggacgttat

SEQ ID NO: 34466 - DNA, 24 bp, Homo sapiens
tcttgattttagatcaggacgtta

SEQ ID NO: 34467 - DNA, 24 bp, Homo sapiens
ctcttgattttagatcaggacgtt

SEQ ID NO: 34468 - DNA, 24 bp, Homo sapiens
gtaattcatctatgaggatggcaa

SEQ ID NO: 34469 - DNA, 24 bp, Homo sapiens
tgtaattcatctatgaggatggca

SEQ ID NO: 34470 - DNA, 24 bp, Homo sapiens
ctgtaattcatctatgaggatggc

SEQ ID NO: 34471 - DNA, 24 bp, Homo sapiens
tgtcagcatctccgtggtcagcag

SEQ ID NO: 34472 - DNA, 24 bp, Homo sapiens
aggtggctatggaggaggttacgg

SEQ ID NO: 34473 - DNA, 24 bp, Homo sapiens
ggcagcatcaagttctcccagtcc

SEQ ID NO: 34474 - DNA, 24 bp, Homo sapiens
atggacaacaaccgcaacctggac

SEQ ID NO: 34475 - DNA, 24 bp, Homo sapiens
attattgccgaggtccgtgcccag

SEQ ID NO: 34476 - DNA, 24 bp, Homo sapiens
cagaggagcaaggctgaggctgaa

SEQ ID NO: 34477 - DNA, 24 bp, Homo sapiens
ggcggccttggcagcagcagcctc

SEQ ID NO: 34478 - DNA, 24 bp, Homo sapiens
ccaggtgcgcctgagctccgctcg

SEQ ID NO: 34479 - DNA, 24 bp, Homo sapiens
tgcctccactcctgcctctaccat

SEQ ID NO: 34480 - DNA, 24 bp, Homo sapiens
cgcagttacggtcaaccagagcct

SEQ ID NO: 34481 - DNA, 24 bp, Homo sapiens
ccaggagaaggagcagatcaagac

SEQ ID NO: 34482 - DNA, 23 bp, Homo sapiens
gaggtgaagatccgtgactggca

SEQ ID NO: 34483 - DNA, 23 bp, Homo sapiens
ctcaacgaccgcctggcttccta

SEQ ID NO: 34484 - DNA, 23 bp, Homo sapiens
ttggaggtggctatggaggtggc

SEQ ID NO: 34485 - DNA, 24 bp, Homo sapiens
caacgccgacctggaagtgaagat

SEQ ID NO: 34486 - DNA, 24 bp, Homo sapiens
ctttgctggtggtgatgggcttct

SEQ ID NO: 34487 - DNA, 24 bp, Homo sapiens
ctgtctcatcctcccgcttctcct

SEQ ID NO: 34488 - DNA, 24 bp, Homo sapiens
ccagaatgcgactacagccaatac

SEQ ID NO: 34489 - DNA, 24 bp, Homo sapiens
tggtggcgatggtggtctcctctc

SEQ ID NO: 34490 - DNA, 24 bp, Homo sapiens
atgagggtctgtggctttggtgga

SEQ ID NO: 34491 - DNA, 24 bp, Homo sapiens
aggtggaagccgaagtatctcagc

SEQ ID NO: 34492 - DNA, 24 bp, Homo sapiens
tggtggcgatggtggtctcctctc

SEQ ID NO: 34493 - DNA, 24 bp, Homo sapiens
atgagggtctgtggctttggtgga

SEQ ID NO: 34494 - DNA, 25 bp, Homo sapiens
aagtagccagtgccagccaatgaag

SEQ ID NO: 34495 - DNA, 25 bp, Homo sapiens
acacgatagagttctccaggttcct

SEQ ID NO: 34496 - DNA, 23 bp, Homo sapiens
cttccaggctcactccagggtcc

SEQ ID NO: 34497 - DNA, 24 bp, Homo sapiens
gctgaccacaaccttcacctcctg

SEQ ID NO: 34498 - DNA, 24 bp, Homo sapiens
agtgattctcctgcctcagcctcc

SEQ ID NO: 34499 - DNA, 24 bp, Homo sapiens
acttcccatagagccgtgtcaccc

SEQ ID NO: 34500 - DNA, 23 bp, Homo sapiens
ctccagacccttgcgatgctcct

SEQ ID NO: 34501 - DNA, 25 bp, Homo sapiens
aacagtctcagaatacggagtcctg

SEQ ID NO: 34502 - DNA, 24 bp, Homo sapiens
cttccagaggctgttccgagtctt

SEQ ID NO: 34503 - DNA, 23 bp, Homo sapiens
taagaacggcggcggcagcagta

SEQ ID NO: 34504 - DNA, 23 bp, Homo sapiens
ccctgccgtttgcgagaccctgg

SEQ ID NO: 34505 - DNA, 25 bp, Homo sapiens
agaggagatggagaagctgcgagag

SEQ ID NO: 34506 - DNA, 23 bp, Homo sapiens
tcactggagacttcacggcacct

SEQ ID NO: 34507 - DNA, 24 bp, Homo sapiens
tcaacatcttgacagatattaatt

SEQ ID NO: 34508 - DNA, 24 bp, Homo sapiens
tctgttcttaggtctttttaagat

SEQ ID NO: 34509 - DNA, 24 bp, Homo sapiens
ttctgttcttaggtctttttaaga

SEQ ID NO: 34510 - DNA, 24 bp, Homo sapiens
attctgttcttaggtctttttaag

SEQ ID NO: 34511 - DNA, 24 bp, Homo sapiens
accacgaagaggaagtaaaaggcc

SEQ ID NO: 34512 - DNA, 24 bp, Homo sapiens
aaccacgaagaggaagtaaaaggc

SEQ ID NO: 34513 - DNA, 24 bp, Homo sapiens
gaaccacgaagaggaagtaaaagg

SEQ ID NO: 34514 - DNA, 23 bp, Homo sapiens
actctgcgtgctgtggtgctccg

SEQ ID NO: 34515 - DNA, 23 bp, Homo sapiens
ctgctgctgcctgtgttcctctg

SEQ ID NO: 34516 - DNA, 24 bp, Homo sapiens
aggagtcagacgatgagaccagcc

SEQ ID NO: 34517 - DNA, 23 bp, Homo sapiens
ggaaccgcagccggagccggagg

SEQ ID NO: 34518 - DNA, 23 bp, Homo sapiens
tcggcggcctgcgctcggcccgg

SEQ ID NO: 34519 - DNA, 23 bp, Homo sapiens
cgctccgccgccagccacccccg

SEQ ID NO: 34520 - DNA, 23 bp, Homo sapiens
gctggagctggacgaggacgagg

SEQ ID NO: 34521 - DNA, 23 bp, Homo sapiens
cagcagagcgcaccgggccgatc

SEQ ID NO: 34522 - DNA, 23 bp, Homo sapiens
cagcacgccggggcccgcgagct

SEQ ID NO: 34523 - DNA, 24 bp, Homo sapiens
gattatgccagagtgggtgtttgt

SEQ ID NO: 34524 - DNA, 24 bp, Homo sapiens
agattatgccagagtgggtgtttg

SEQ ID NO: 34525 - DNA, 24 bp, Homo sapiens
gagattatgccagagtgggtgttt

SEQ ID NO: 34526 - DNA, 25 bp, Homo sapiens
tgctgtggagattatgccagagtgg

SEQ ID NO: 34527 - DNA, 24 bp, Homo sapiens
ggcgtcttcctcttcttcgtcctg

SEQ ID NO: 34528 - DNA, 23 bp, Homo sapiens
ctgctgctgctatgtccgctgcc

SEQ ID NO: 34529 - DNA, 24 bp, Homo sapiens
tttactccaaggggaagagctact

SEQ ID NO: 34530 - DNA, 24 bp, Homo sapiens
ttttactccaaggggaagagctac

SEQ ID NO: 34531 - DNA, 24 bp, Homo sapiens
tttttactccaaggggaagagcta

SEQ ID NO: 34532 - DNA, 25 bp, Homo sapiens
agaacctcagagaacaccagatgct

SEQ ID NO: 34533 - DNA, 24 bp, Homo sapiens
gattacaggcacccgctaccacac

SEQ ID NO: 34534 - DNA, 23 bp, Homo sapiens
ctaggctagagggcagtggcacc

SEQ ID NO: 34535 - DNA, 25 bp, Homo sapiens
gcgttctatgccaaccttgaatgcc

SEQ ID NO: 34536 - DNA, 23 bp, Homo sapiens
gctggatgattgtggctggctgt

SEQ ID NO: 34537 - DNA, 25 bp, Homo sapiens
actcaggattacgcacaaacggcat

SEQ ID NO: 34538 - DNA, 25 bp, Homo sapiens
gcggtggctcagatacaggatttcg

SEQ ID NO: 34539 - DNA, 23 bp, Homo sapiens
ccctcttccctctccctgacacg

SEQ ID NO: 34540 - DNA, 23 bp, Homo sapiens
gctcctgggctcaagcgatctgc

SEQ ID NO: 34541 - DNA, 25 bp, Homo sapiens
caacctgggcgaaatggagtatgaa

SEQ ID NO: 34542 - DNA, 25 bp, Homo sapiens
gctgaggcagaaggatagtttgagt

SEQ ID NO: 34543 - DNA, 24 bp, Homo sapiens
agtgactcatgcctgtaatctcgg

SEQ ID NO: 34544 - DNA, 24 bp, Homo sapiens
tcaggaaggaggactctgaacagt

SEQ ID NO: 34545 - DNA, 24 bp, Homo sapiens
ttcaggaaggaggactctgaacag

SEQ ID NO: 34546 - DNA, 24 bp, Homo sapiens
tttcaggaaggaggactctgaaca

SEQ ID NO: 34547 - DNA, 24 bp, Homo sapiens
ttttttttgaggtggagtctcact

SEQ ID NO: 34548 - DNA, 24 bp, Homo sapiens
tttttttttgaggtggagtctcac

SEQ ID NO: 34549 - DNA, 24 bp, Homo sapiens
tttttttttgaggtggagtctcac

SEQ ID NO: 34550 - DNA, 25 bp, Homo sapiens
aggtgccttcaggttgagaatgagc

SEQ ID NO: 34551 - DNA, 23 bp, Homo sapiens
agtctcactctgtcaccaggctg

SEQ ID NO: 34552 - DNA, 25 bp, Homo sapiens
gcaatctcggctcaatgtaacctcc

SEQ ID NO: 34553 - DNA, 25 bp, Homo sapiens
gcaatctcggctcaatgtaacctcc

SEQ ID NO: 34554 - DNA, 24 bp, Homo sapiens
ctacaccacagagtccaccacagg

SEQ ID NO: 34555 - DNA, 23 bp, Homo sapiens
gtgccgcatcatagccaaggagg

SEQ ID NO: 34556 - DNA, 25 bp, Homo sapiens
gcaatctcggctcaatgtaacctcc

SEQ ID NO: 34557 - DNA, 23 bp, Homo sapiens
agtctcactctgtcaccaggctg

SEQ ID NO: 34558 - DNA, 23 bp, Homo sapiens
gcctgcgtgagtgagaccctgag

SEQ ID NO: 34559 - DNA, 24 bp, Homo sapiens
ccgacatcctgactgacaacagcc

SEQ ID NO: 34560 - DNA, 25 bp, Homo sapiens
agtagcttcctggagagcatggagg

SEQ ID NO: 34561 - DNA, 23 bp, Homo sapiens
ggctgaggctgcggctgtggtgg

SEQ ID NO: 34562 - DNA, 24 bp, Homo sapiens
cagagattgtgggtcagatgcggc

SEQ ID NO: 34563 - DNA, 24 bp, Homo sapiens
aattctgttcaagaccagggcttt

SEQ ID NO: 34564 - DNA, 24 bp, Homo sapiens
aggtggctggatatgtggcaagga

SEQ ID NO: 34565 - DNA, 25 bp, Homo sapiens
aagggcaggagaagatggatgtcac

SEQ ID NO: 34566 - DNA, 23 bp, Homo sapiens
aattccagtctgagtccacaggc

SEQ ID NO: 34567 - DNA, 25 bp, Homo sapiens
ggctggtctcgaactccttgtctca

SEQ ID NO: 34568 - DNA, 23 bp, Homo sapiens
gttcagtggcacgatctccgctc

SEQ ID NO: 34569 - DNA, 25 bp, Homo sapiens
tcaagtgattctcctgcctcagcct

SEQ ID NO: 34570 - DNA, 24 bp, Homo sapiens
gcaaagatacagagggtctcgctc

SEQ ID NO: 34571 - DNA, 24 bp, Homo sapiens
ggattctgtaaagcccgttgccca

SEQ ID NO: 34572 - DNA, 25 bp, Homo sapiens
agttatggaagacaggcagagtgga

SEQ ID NO: 34573 - DNA, 24 bp, Homo sapiens
aggtcatggaggtggatctggcaa

SEQ ID NO: 34574 - DNA, 24 bp, Homo sapiens
gatcaagaatgcaataatacaaga

SEQ ID NO: 34575 - DNA, 24 bp, Homo sapiens
ggatcaagaatgcaataatacaag

SEQ ID NO: 34576 - DNA, 24 bp, Homo sapiens
tggatcaagaatgcaataatacaa

SEQ ID NO: 34577 - DNA, 24 bp, Homo sapiens
cagcaagatccaggtttttcatta

SEQ ID NO: 34578 - DNA, 24 bp, Homo sapiens
acagcaagatccaggtttttcatt

SEQ ID NO: 34579 - DNA, 24 bp, Homo sapiens
tacagcaagatccaggtttttcat

SEQ ID NO: 34580 - DNA, 24 bp, Homo sapiens
cgcatccaagcctacgactacctc

SEQ ID NO: 34581 - DNA, 24 bp, Homo sapiens
gacgagcatgtccgcacagagctg

SEQ ID NO: 34582 - DNA, 24 bp, Homo sapiens
tgtcccaatgtgcccatcatcctg

SEQ ID NO: 34583 - DNA, 24 bp, Homo sapiens
aggatctggagaaacaacagaata

SEQ ID NO: 34584 - DNA, 24 bp, Homo sapiens
aaggatctggagaaacaacagaat

SEQ ID NO: 34585 - DNA, 24 bp, Homo sapiens
gaaggatctggagaaacaacagaa

SEQ ID NO: 34586 - DNA, 24 bp, Homo sapiens
tcaaggagctggagcgtctggaag

SEQ ID NO: 34587 - DNA, 24 bp, Homo sapiens
ttcaaggagctggagcgtctggaa

SEQ ID NO: 34588 - DNA, 24 bp, Homo sapiens
cttcaaggagctggagcgtctgga

SEQ ID NO: 34589 - DNA, 24 bp, Homo sapiens
tggaggagaaggcagacctgagtg

SEQ ID NO: 34590 - DNA, 24 bp, Homo sapiens
tggagaaagaagaacttggattct

SEQ ID NO: 34591 - DNA, 24 bp, Homo sapiens
ggcgactacaagggacacagcaaa

SEQ ID NO: 34592 - DNA, 24 bp, Homo sapiens
gtgactgcccagaaccctgctcat

SEQ ID NO: 34593 - DNA, 24 bp, Homo sapiens
agtccaggagccccagccccccag

SEQ ID NO: 34594 - DNA, 24 bp, Homo sapiens
catttaaatgtgttgaccctgata

SEQ ID NO: 34595 - DNA, 24 bp, Homo sapiens
ccatttaaatgtgttgaccctgat

SEQ ID NO: 34596 - DNA, 24 bp, Homo sapiens
gccatttaaatgtgttgaccctga

SEQ ID NO: 34597 - DNA, 24 bp, Homo sapiens
gaaggatccaaatgaaaaaattga

SEQ ID NO: 34598 - DNA, 24 bp, Homo sapiens
ggaaggatccaaatgaaaaaattg

SEQ ID NO: 34599 - DNA, 24 bp, Homo sapiens
gggaaggatccaaatgaaaaaatt

SEQ ID NO: 34600 - DNA, 25 bp, Homo sapiens
aggcatcagattctcataaggagcg

SEQ ID NO: 34601 - DNA, 23 bp, Homo sapiens
tgctgatctgacaggaggcggat

SEQ ID NO: 34602 - DNA, 25 bp, Homo sapiens
cgcagtccacaatggtgttctcact

SEQ ID NO: 34603 - DNA, 24 bp, Homo sapiens
acgctgtgtgggctcaagatgaag

SEQ ID NO: 34604 - DNA, 24 bp, Homo sapiens
tggaggaggagctggagttggagc

SEQ ID NO: 34605 - DNA, 24 bp, Homo sapiens
gcgaatggtcagacgaatccgagg

SEQ ID NO: 34606 - DNA, 24 bp, Homo sapiens
gcgaatggtcagacgaatccgagg

SEQ ID NO: 34607 - DNA, 24 bp, Homo sapiens
acgctgtgtgggctcaagatgaag

SEQ ID NO: 34608 - DNA, 24 bp, Homo sapiens
ggaggaggagctggagttggagcg

SEQ ID NO: 34609 - DNA, 24 bp, Homo sapiens
acgctgtgtgggctcaagatgaag

SEQ ID NO: 34610 - DNA, 24 bp, Homo sapiens
gcgaatggtcagacgaatccgagg

SEQ ID NO: 34611 - DNA, 24 bp, Homo sapiens
ggtggtggtggatgatgaagtgcc

SEQ ID NO: 34612 - DNA, 24 bp, Homo sapiens
aaataatgaagatgagaaagctga

SEQ ID NO: 34613 - DNA, 24 bp, Homo sapiens
aaaataatgaagatgagaaagctg

SEQ ID NO: 34614 - DNA, 24 bp, Homo sapiens
gaaaataatgaagatgagaaagct

SEQ ID NO: 34615 - DNA, 23 bp, Homo sapiens
gcatcagtctctgggtagctggg

SEQ ID NO: 34616 - DNA, 24 bp, Homo sapiens
tgcccagactggtctcaaactccc

SEQ ID NO: 34617 - DNA, 23 bp, Homo sapiens
ggtggtcctcctgccttggcctc

SEQ ID NO: 34618 - DNA, 23 bp, Homo sapiens
aagtcgtgatccacccgccttgg

SEQ ID NO: 34619 - DNA, 23 bp, Homo sapiens
gtgttggccaggatggtctcaat

SEQ ID NO: 34620 - DNA, 24 bp, Homo sapiens
cacccggctgaaattgtatacttt

SEQ ID NO: 34621 - DNA, 24 bp, Homo sapiens
tgcgacagccatgaaggaagaacc

SEQ ID NO: 34622 - DNA, 23 bp, Homo sapiens
gcagccacggagtcacgaccacg

SEQ ID NO: 34623 - DNA, 25 bp, Homo sapiens
ctgagaccaactctcctggacacca

SEQ ID NO: 34624 - DNA, 23 bp, Homo sapiens
gctcagcgaggagtccacgaagg

SEQ ID NO: 34625 - DNA, 23 bp, Homo sapiens
gcgactgcacgtagctgaggaag

SEQ ID NO: 34626 - DNA, 23 bp, Homo sapiens
ctagcggctgcggcggcggtggc

SEQ ID NO: 34627 - DNA, 24 bp, Homo sapiens
tggaagaactgccctcatacttgc

SEQ ID NO: 34628 - DNA, 24 bp, Homo sapiens
agaagcatggaagtaatcctgtgg

SEQ ID NO: 34629 - DNA, 24 bp, Homo sapiens
agtgctggcaatggtgatgatgga

SEQ ID NO: 34630 - DNA, 24 bp, Homo sapiens
gagcggcagaaccaggagtaccag

SEQ ID NO: 34631 - DNA, 24 bp, Homo sapiens
ggagatcatcgagctgagacgcac

SEQ ID NO: 34632 - DNA, 24 bp, Homo sapiens
ctgaacaagcaggtggtatccagc

SEQ ID NO: 34633 - DNA, 24 bp, Homo sapiens
tgacttcgtgatccacctgcctct

SEQ ID NO: 34634 - DNA, 24 bp, Homo sapiens
tcccagagcaggaagatggcacat

SEQ ID NO: 34635 - DNA, 24 bp, Homo sapiens
agcaattgatgtgatccctgttgg

SEQ ID NO: 34636 - DNA, 23 bp, Homo sapiens
gctggtggctgtggacaaggctg

SEQ ID NO: 34637 - DNA, 24 bp, Homo sapiens
cgaactgaaggtgacaggtgatgc

SEQ ID NO: 34638 - DNA, 25 bp, Homo sapiens
gccattattgatgtgacttcagcga

SEQ ID NO: 34639 - DNA, 24 bp, Homo sapiens
cagctcgtgttcaaccatatacct

SEQ ID NO: 34640 - DNA, 24 bp, Homo sapiens
cacagccagccagcctcatcttac

SEQ ID NO: 34641 - DNA, 23 bp, Homo sapiens
actgtggccgtggagctgctcag

SEQ ID NO: 34642 - DNA, 23 bp, Homo sapiens
cctgttccgcgccaggcatggcc

SEQ ID NO: 34643 - DNA, 23 bp, Homo sapiens
ctcgtctcgcccggcctccccgc

SEQ ID NO: 34644 - DNA, 24 bp, Homo sapiens
tgtggagcaggtggaggagcagtg

SEQ ID NO: 34645 - DNA, 24 bp, Homo sapiens
aggctgagaagatgaagaagacca

SEQ ID NO: 34646 - DNA, 24 bp, Homo sapiens
taaactcgctcacagagagggacg

SEQ ID NO: 34647 - DNA, 23 bp, Homo sapiens
cctgatccttctggacacggagg

SEQ ID NO: 34648 - DNA, 25 bp, Homo sapiens
tgaagtctgaaaccaaaggcatctg

SEQ ID NO: 34649 - DNA, 23 bp, Homo sapiens
gtgccccacccctccaagccaaa

SEQ ID NO: 34650 - DNA, 24 bp, Homo sapiens
ttctctttctggagttgcattttt

SEQ ID NO: 34651 - DNA, 24 bp, Homo sapiens
tttctctttctggagttgcatttt

SEQ ID NO: 34652 - DNA, 24 bp, Homo sapiens
ttttctctttctggagttgcattt

SEQ ID NO: 34653 - DNA, 23 bp, Homo sapiens
ttggtggtgtcattgccttctcc

SEQ ID NO: 34654 - DNA, 25 bp, Homo sapiens
cctggtgtccttcatcaacttcttc

SEQ ID NO: 34655 - DNA, 23 bp, Homo sapiens
tggtgtttgctgtgctgggcttc

SEQ ID NO: 34656 - DNA, 25 bp, Homo sapiens
cctggagtgaatgtcctgtcgtcag

SEQ ID NO: 34657 - DNA, 23 bp, Homo sapiens
gcagtggtggaggcagagtgtga

SEQ ID NO: 34658 - DNA, 25 bp, Homo sapiens
caactggaagatgaccctgtgcctc

SEQ ID NO: 34659 - DNA, 25 bp, Homo sapiens
caactggaagatgaccctgtgcctc

SEQ ID NO: 34660 - DNA, 24 bp, Homo sapiens
ggacatctctgactccatctcgga

SEQ ID NO: 34661 - DNA, 23 bp, Homo sapiens
gcagtggtggaggcagagtgtga

SEQ ID NO: 34662 - DNA, 24 bp, Homo sapiens
ccaaagccaaggagagagcaaggg

SEQ ID NO: 34663 - DNA, 25 bp, Homo sapiens
ttgggcttctgttcctttcacttgc

SEQ ID NO: 34664 - DNA, 25 bp, Homo sapiens
gggatggataggaaagcaggctgag

SEQ ID NO: 34665 - DNA, 24 bp, Homo sapiens
tcgcacatctcagacacctccgtg

SEQ ID NO: 34666 - DNA, 24 bp, Homo sapiens
ccgagattaaggcacagtatgacg

SEQ ID NO: 34667 - DNA, 24 bp, Homo sapiens
gccgcaccaaggaggagatcaatg

SEQ ID NO: 34668 - DNA, 24 bp, Homo sapiens
actgggatatggagttttggggca

SEQ ID NO: 34669 - DNA, 24 bp, Homo sapiens
agagtggagatcaacactaatatt

SEQ ID NO: 34670 - DNA, 25 bp, Homo sapiens
tcatttttaaataatacactttcag

SEQ ID NO: 34671 - DNA, 24 bp, Homo sapiens
gttcacgccattctcctgcctcag

SEQ ID NO: 34672 - DNA, 24 bp, Homo sapiens
gagtgttatctccgccagcacctg

SEQ ID NO: 34673 - DNA, 24 bp, Homo sapiens
tctcctcaacttgcgatccgtccg

SEQ ID NO: 34674 - DNA, 24 bp, Homo sapiens
atgaaacgagggcaatcagggtcc

SEQ ID NO: 34675 - DNA, 24 bp, Homo sapiens
tgtgcttgtggtggtggttgtctc

SEQ ID NO: 34676 - DNA, 24 bp, Homo sapiens
gcggtgatgtcagcggagcctcag

SEQ ID NO: 34677 - DNA, 24 bp, Homo sapiens
acaaagacctgtgttcccagtgcc

SEQ ID NO: 34678 - DNA, 24 bp, Homo sapiens
atgaaacgagggcaatcagggtcc

SEQ ID NO: 34679 - DNA, 24 bp, Homo sapiens
tgtgcttgtggtggtggttgtctc

SEQ ID NO: 34680 - DNA, 24 bp, Homo sapiens
ctcgactggagccctgggcatgga

SEQ ID NO: 34681 - DNA, 24 bp, Homo sapiens
actcgactggagccctgggcatgg

SEQ ID NO: 34682 - DNA, 24 bp, Homo sapiens
aactcgactggagccctgggcatg

SEQ ID NO: 34683 - DNA, 24 bp, Homo sapiens
tggttccacattctgtcctgctgt

SEQ ID NO: 34684 - DNA, 24 bp, Homo sapiens
tcagtggctgttgcagaggaagag

SEQ ID NO: 34685 - DNA, 24 bp, Homo sapiens
taggggaagcaaggtgaaagtggt

SEQ ID NO: 34686 - DNA, 24 bp, Homo sapiens
tatgttatttgttttggatacatc

SEQ ID NO: 34687 - DNA, 24 bp, Homo sapiens
ctatgttatttgttttggatacat

SEQ ID NO: 34688 - DNA, 24 bp, Homo sapiens
tctatgttatttgttttggataca

SEQ ID NO: 34689 - DNA, 25 bp, Homo sapiens
ttcttcatctggagacagttcaacg

SEQ ID NO: 34690 - DNA, 24 bp, Homo sapiens
gctcagccaatcagtgacatcatt

SEQ ID NO: 34691 - DNA, 23 bp, Homo sapiens
cgagcaggcaggcaccagaagag

SEQ ID NO: 34692 - DNA, 24 bp, Homo sapiens
ccgggctcctgaacctcaagaagg

SEQ ID NO: 34693 - DNA, 24 bp, Homo sapiens
accgggctcctgaacctcaagaag

SEQ ID NO: 34694 - DNA, 24 bp, Homo sapiens
caccgggctcctgaacctcaagaa

SEQ ID NO: 34695 - DNA, 24 bp, Homo sapiens
actggagaatgatttgattgtgga

SEQ ID NO: 34696 - DNA, 24 bp, Homo sapiens
cactggagaatgatttgattgtgg

SEQ ID NO: 34697 - DNA, 24 bp, Homo sapiens
acactggagaatgatttgattgtg

SEQ ID NO: 34698 - DNA, 24 bp, Homo sapiens
ccaacctgatgcaattaaccacgt

SEQ ID NO: 34699 - DNA, 24 bp, Homo sapiens
ccacagcagaagcagcaccggcag

SEQ ID NO: 34700 - DNA, 24 bp, Homo sapiens
ccactgaacaacgctgtccccgcc

SEQ ID NO: 34701 - DNA, 24 bp, Homo sapiens
cacgctgacctggcttgttcctac

SEQ ID NO: 34702 - DNA, 23 bp, Homo sapiens
gggctcattgtctgggcttcctc

SEQ ID NO: 34703 - DNA, 23 bp, Homo sapiens
agagccaggtggtggtgctgtaa

SEQ ID NO: 34704 - DNA, 23 bp, Homo sapiens
gcggacgggtgctcactgctttc

SEQ ID NO: 34705 - DNA, 23 bp, Homo sapiens
tccttgctggggtggagtttgcc

SEQ ID NO: 34706 - DNA, 23 bp, Homo sapiens
aacagctggggtcataagcaagg

SEQ ID NO: 34707 - DNA, 24 bp, Homo sapiens
gtgacttgctcctccttgccttcc

SEQ ID NO: 34708 - DNA, 24 bp, Homo sapiens
ctcctcctgtcgtggttccttcgg

SEQ ID NO: 34709 - DNA, 24 bp, Homo sapiens
gccgttctttcctgccctgttctc

SEQ ID NO: 34710 - DNA, 25 bp, Homo sapiens
acacagtcatgctgatgtcattgcc

SEQ ID NO: 34711 - DNA, 23 bp, Homo sapiens
gctgtggctccttaatgctttgg

SEQ ID NO: 34712 - DNA, 24 bp, Homo sapiens
taaattctgggctggcacagtggc

SEQ ID NO: 34713 - DNA, 25 bp, Homo sapiens
tgtgaggaactgagaacttgagagg

SEQ ID NO: 34714 - DNA, 25 bp, Homo sapiens
acacagtcatgctgatgtcattgcc

SEQ ID NO: 34715 - DNA, 24 bp, Homo sapiens
taaattctgggctggcacagtggc

SEQ ID NO: 34716 - DNA, 24 bp, Homo sapiens
gagcgagagcattaagtaggcagg

SEQ ID NO: 34717 - DNA, 24 bp, Homo sapiens
acaggtgggagcagtcagacagcc

SEQ ID NO: 34718 - DNA, 24 bp, Homo sapiens
gatcgaccgaggctggctggctag

SEQ ID NO: 34719 - DNA, 24 bp, Homo sapiens
acagggatgtgatgctggagaatt

SEQ ID NO: 34720 - DNA, 23 bp, Homo sapiens
tctctgagaacgaatggatcggc

SEQ ID NO: 34721 - DNA, 24 bp, Homo sapiens
gtcagtgaccttcgaggatgtggc

SEQ ID NO: 34722 - DNA, 24 bp, Homo sapiens
gttttctctttgattttatgttct

SEQ ID NO: 34723 - DNA, 24 bp, Homo sapiens
tgttttctctttgattttatgttc

SEQ ID NO: 34724 - DNA, 24 bp, Homo sapiens
ctgttttctctttgattttatgtt

SEQ ID NO: 34725 - DNA, 25 bp, Homo sapiens
agaacgctttgaactgacagaggct

SEQ ID NO: 34726 - DNA, 25 bp, Homo sapiens
ttcttcaggagacagtgcgtagaga

SEQ ID NO: 34727 - DNA, 25 bp, Homo sapiens
tgctggctcaaacacaactgataga

SEQ ID NO: 34728 - DNA, 23 bp, Homo sapiens
tgttggcacactcctgtagtccc

SEQ ID NO: 34729 - DNA, 23 bp, Homo sapiens
tcgggaggctgaactgggaagat

SEQ ID NO: 34730 - DNA, 25 bp, Homo sapiens
tgattatgccactacactccagcct

SEQ ID NO: 34731 - DNA, 24 bp, Homo sapiens
aagtattacagttagaaatgaaac

SEQ ID NO: 34732 - DNA, 24 bp, Homo sapiens
aaagtattacagttagaaatgaaa

SEQ ID NO: 34733 - DNA, 24 bp, Homo sapiens
caaagtattacagttagaaatgaa

SEQ ID NO: 34734 - DNA, 24 bp, Homo sapiens
aagtattacagggtgctgagaaaa

SEQ ID NO: 34735 - DNA, 24 bp, Homo sapiens
aaagtattacagggtgctgagaaa

SEQ ID NO: 34736 - DNA, 24 bp, Homo sapiens
caaagtattacagggtgctgagaa

SEQ ID NO: 34737 - DNA, 24 bp, Homo sapiens
agaagacaccaagaccacctcctg

SEQ ID NO: 34738 - DNA, 24 bp, Homo sapiens
ctctgtaggcttgccaaagaaggg

SEQ ID NO: 34739 - DNA, 24 bp, Homo sapiens
ttgaccagagttgaagtgacagaa

SEQ ID NO: 34740 - DNA, 23 bp, Homo sapiens
aggtcgagcttcaggagagcgtt

SEQ ID NO: 34741 - DNA, 23 bp, Homo sapiens
ctccaaggaacccagaagagcgg

SEQ ID NO: 34742 - DNA, 23 bp, Homo sapiens
cctccacctccagcagccttgat

SEQ ID NO: 34743 - DNA, 24 bp, Homo sapiens
tttcagattctttgttttctgcca

SEQ ID NO: 34744 - DNA, 24 bp, Homo sapiens
gtttcagattctttgttttctgcc

SEQ ID NO: 34745 - DNA, 24 bp, Homo sapiens
agtttcagattctttgttttctgc

SEQ ID NO: 34746 - DNA, 24 bp, Homo sapiens
tcaaatacaagcaaggggccttcc

SEQ ID NO: 34747 - DNA, 24 bp, Homo sapiens
ttcaaatacaagcaaggggccttc

SEQ ID NO: 34748 - DNA, 24 bp, Homo sapiens
tttcaaatacaagcaaggggcctt

SEQ ID NO: 34749 - DNA, 24 bp, Homo sapiens
atcatgtttcagagaagtaatcta

SEQ ID NO: 34750 - DNA, 24 bp, Homo sapiens
aatcatgtttcagagaagtaatct

SEQ ID NO: 34751 - DNA, 24 bp, Homo sapiens
aaatcatgtttcagagaagtaatc

SEQ ID NO: 34752 - DNA, 25 bp, Homo sapiens
aagcaagagatccttcaccgatcca

SEQ ID NO: 34753 - DNA, 25 bp, Homo sapiens
cctctcctctcttctcctctcctcc

SEQ ID NO: 34754 - DNA, 25 bp, Homo sapiens
caatggctcaatctcggttcactgc

SEQ ID NO: 34755 - DNA, 24 bp, Homo sapiens
cctggaagtatgtcaactgccaca

SEQ ID NO: 34756 - DNA, 24 bp, Homo sapiens
tctcgctgtgtcatcaaggctgga

SEQ ID NO: 34757 - DNA, 24 bp, Homo sapiens
agctcactgcaaccttcatctcca

SEQ ID NO: 34758 - DNA, 25 bp, Homo sapiens
ttcttgctgcggttgattctggtgt

SEQ ID NO: 34759 - DNA, 25 bp, Homo sapiens
cccacccaagaatgagaggaagttt

SEQ ID NO: 34760 - DNA, 24 bp, Homo sapiens
gctgtcgttcatccttccctgaga

SEQ ID NO: 34761 - DNA, 23 bp, Homo sapiens
tgttgctgctgctgctgctgctc

SEQ ID NO: 34762 - DNA, 23 bp, Homo sapiens
cggatgctaacacccaggaaggc

SEQ ID NO: 34763 - DNA, 23 bp, Homo sapiens
ggtccccaccgccaaagccgctc

SEQ ID NO: 34764 - DNA, 24 bp, Homo sapiens
ctattaaacaggtatttacaaaag

SEQ ID NO: 34765 - DNA, 24 bp, Homo sapiens
actattaaacaggtatttacaaaa

SEQ ID NO: 34766 - DNA, 24 bp, Homo sapiens
gactattaaacaggtatttacaaa

SEQ ID NO: 34767 - DNA, 24 bp, Homo sapiens
gccacatccgcttcttctccttct

SEQ ID NO: 34768 - DNA, 24 bp, Homo sapiens
aacctcggcatcaccaatggcttc

SEQ ID NO: 34769 - DNA, 24 bp, Homo sapiens
tcatcagagttcaccatcctgcgg

SEQ ID NO: 34770 - DNA, 24 bp, Homo sapiens
cccgatgaagaagatcccaggctc

SEQ ID NO: 34771 - DNA, 24 bp, Homo sapiens
gtgagagcccagaccctccagaag

SEQ ID NO: 34772 - DNA, 24 bp, Homo sapiens
ggaagggaaggaaaacctgaaacc

SEQ ID NO: 34773 - DNA, 24 bp, Homo sapiens
gcatttcacaggtaagtacaaaat

SEQ ID NO: 34774 - DNA, 24 bp, Homo sapiens
agcatttcacaggtaagtacaaaa

SEQ ID NO: 34775 - DNA, 24 bp, Homo sapiens
aagcatttcacaggtaagtacaaa

SEQ ID NO: 34776 - DNA, 25 bp, Homo sapiens
aaggctgaccgcaaatacgagaagg

SEQ ID NO: 34777 - DNA, 25 bp, Homo sapiens
gaggagaagatggagattcaggaga

SEQ ID NO: 34778 - DNA, 25 bp, Homo sapiens
gcagatgagagtgaaagaggaatga

SEQ ID NO: 34779 - DNA, 24 bp, Homo sapiens
gattaagaaagaatataccacagc

SEQ ID NO: 34780 - DNA, 24 bp, Homo sapiens
agattaagaaagaatataccacag

SEQ ID NO: 34781 - DNA, 24 bp, Homo sapiens
aagattaagaaagaatataccaca

SEQ ID NO: 34782 - DNA, 25 bp, Homo sapiens
actatgtcttggagctgaacctgcc

SEQ ID NO: 34783 - DNA, 24 bp, Homo sapiens
ccaaggagaagacctacctgcgtt

SEQ ID NO: 34784 - DNA, 23 bp, Homo sapiens
ctgagcagcccacgagccacctg

SEQ ID NO: 34785 - DNA, 24 bp, Homo sapiens
gacagtgacaagtacttcatagag

SEQ ID NO: 34786 - DNA, 24 bp, Homo sapiens
ggacagtgacaagtacttcataga

SEQ ID NO: 34787 - DNA, 24 bp, Homo sapiens
gggacagtgacaagtacttcatag

SEQ ID NO: 34788 - DNA, 24 bp, Homo sapiens
ctgaacctgccgcctccgtgcctg

SEQ ID NO: 34789 - DNA, 24 bp, Homo sapiens
gctcgcttcttgactcgcgttggt

SEQ ID NO: 34790 - DNA, 24 bp, Homo sapiens
gacggaggaagctgccggtataac

SEQ ID NO: 34791 - DNA, 24 bp, Homo sapiens
aaaatgagaagagtattgttacaa

SEQ ID NO: 34792 - DNA, 24 bp, Homo sapiens
aaaaatgagaagagtattgttaca

SEQ ID NO: 34793 - DNA, 24 bp, Homo sapiens
taaaaatgagaagagtattgttac

SEQ ID NO: 34794 - DNA, 24 bp, Homo sapiens
cagaaacagcccagcccagtgaac

SEQ ID NO: 34795 - DNA, 24 bp, Homo sapiens
gactggctgattcaacaaggcacc

SEQ ID NO: 34796 - DNA, 24 bp, Homo sapiens
tgccatcaatgactccaaggttcc

SEQ ID NO: 34797 - DNA, 23 bp, Homo sapiens
caccagcaccagcacctagcgta

SEQ ID NO: 34798 - DNA, 23 bp, Homo sapiens
agcagcagcagcaacagcagcag

SEQ ID NO: 34799 - DNA, 23 bp, Homo sapiens
accagctccaccagctccaccag

SEQ ID NO: 34800 - DNA, 23 bp, Homo sapiens
gctcaacgacatccgcatcagtg

SEQ ID NO: 34801 - DNA, 25 bp, Homo sapiens
ccctctccctccaaacatgacattt

SEQ ID NO: 34802 - DNA, 23 bp, Homo sapiens
tgttcaagcagcagcccacctgc

SEQ ID NO: 34803 - DNA, 24 bp, Homo sapiens
ctcgctgatggcactggccgactt

SEQ ID NO: 34804 - DNA, 24 bp, Homo sapiens
tctcgctgatggcactggccgact

SEQ ID NO: 34805 - DNA, 24 bp, Homo sapiens
gtctcgctgatggcactggccgac

SEQ ID NO: 34806 - DNA, 25 bp, Homo sapiens
ggacgcacagttaagatgacaggac

SEQ ID NO: 34807 - DNA, 23 bp, Homo sapiens
cctctttcgcctcctccgctttg

SEQ ID NO: 34808 - DNA, 23 bp, Homo sapiens
gattcacttgcctcagcctccca

SEQ ID NO: 34809 - DNA, 25 bp, Homo sapiens
tggtggacaggttcattagcctcct

SEQ ID NO: 34810 - DNA, 24 bp, Homo sapiens
ccagagacgagcctccgagtacat

SEQ ID NO: 34811 - DNA, 25 bp, Homo sapiens
cgaactcctgacctcaagtgatcca

SEQ ID NO: 34812 - DNA, 24 bp, Homo sapiens
tcgaatacatcgtaagtttctttc

SEQ ID NO: 34813 - DNA, 24 bp, Homo sapiens
atcgaatacatcgtaagtttcttt

SEQ ID NO: 34814 - DNA, 24 bp, Homo sapiens
catcgaatacatcgtaagtttctt

SEQ ID NO: 34815 - DNA, 24 bp, Homo sapiens
aaataatccgggtaagattattct

SEQ ID NO: 34816 - DNA, 24 bp, Homo sapiens
gaaataatccgggtaagattattc

SEQ ID NO: 34817 - DNA, 24 bp, Homo sapiens
agaaataatccgggtaagattatt

SEQ ID NO: 34818 - DNA, 24 bp, Homo sapiens
ttccaaataagagaaaggtgatgc

SEQ ID NO: 34819 - DNA, 24 bp, Homo sapiens
tttccaaataagagaaaggtgatg

SEQ ID NO: 34820 - DNA, 24 bp, Homo sapiens
atttccaaataagagaaaggtgat

SEQ ID NO: 34821 - DNA, 24 bp, Homo sapiens
tgactcagacaaagactgggtgaa

SEQ ID NO: 34822 - DNA, 24 bp, Homo sapiens
gaactccagcccaggttgccttgt

SEQ ID NO: 34823 - DNA, 24 bp, Homo sapiens
ggtggtggtcctggtgaagagctt

SEQ ID NO: 34824 - DNA, 24 bp, Homo sapiens
agtacagtggcacgatctcggctc

SEQ ID NO: 34825 - DNA, 24 bp, Homo sapiens
ggttcaagcatgtacctctgcctc

SEQ ID NO: 34826 - DNA, 24 bp, Homo sapiens
ggtggtggtcctggtgaagagctt

SEQ ID NO: 34827 - DNA, 24 bp, Homo sapiens
ccaggttgccttgtgctaccagct

SEQ ID NO: 34828 - DNA, 24 bp, Homo sapiens
cattgctgaaaagcccaggcgaac

SEQ ID NO: 34829 - DNA, 24 bp, Homo sapiens
aagcagtgtaggatgtggtggaac

SEQ ID NO: 34830 - DNA, 24 bp, Homo sapiens
aaagcagtgtaggatgtggtggaa

SEQ ID NO: 34831 - DNA, 24 bp, Homo sapiens
gaaagcagtgtaggatgtggtgga

SEQ ID NO: 34832 - DNA, 24 bp, Homo sapiens
cttggcagcaggctgtgggcagaa

SEQ ID NO: 34833 - DNA, 24 bp, Homo sapiens
tcttggcagcaggctgtgggcaga

SEQ ID NO: 34834 - DNA, 24 bp, Homo sapiens
gtcttggcagcaggctgtgggcag

SEQ ID NO: 34835 - DNA, 24 bp, Homo sapiens
gcggcaggagaagcaagatgaatg

SEQ ID NO: 34836 - DNA, 24 bp, Homo sapiens
atcctgtggtcatcgtctcggcgg

SEQ ID NO: 34837 - DNA, 24 bp, Homo sapiens
aggttccttcaatggtgccttagc

SEQ ID NO: 34838 - DNA, 23 bp, Homo sapiens
gcacctacccgacttgacccaga

SEQ ID NO: 34839 - DNA, 25 bp, Homo sapiens
aatggctgctgctctgtcttctgtg

SEQ ID NO: 34840 - DNA, 25 bp, Homo sapiens
cctgctcccttctatggtggctttg

SEQ ID NO: 34841 - DNA, 24 bp, Homo sapiens
tcagagcctccgactgggtcattt

SEQ ID NO: 34842 - DNA, 24 bp, Homo sapiens
gccctctcctgccgcctccgtctg

SEQ ID NO: 34843 - DNA, 24 bp, Homo sapiens
ccccatcaccacttagcggaaagc

SEQ ID NO: 34844 - DNA, 24 bp, Homo sapiens
caccagccgccttccaccaagtcc

SEQ ID NO: 34845 - DNA, 24 bp, Homo sapiens
ccagtctgtcccttcaggcactac

SEQ ID NO: 34846 - DNA, 24 bp, Homo sapiens
gcacccagggaatgtgacctcttg

SEQ ID NO: 34847 - DNA, 24 bp, Homo sapiens
tttctctgactcgcagctctcggg

SEQ ID NO: 34848 - DNA, 24 bp, Homo sapiens
ggaagcactgccgccgccgcaaag

SEQ ID NO: 34849 - DNA, 24 bp, Homo sapiens
aagaggttcgagatccagcgctac

SEQ ID NO: 34850 - DNA, 24 bp, Homo sapiens
ggcgactacaagggacacagcaaa

SEQ ID NO: 34851 - DNA, 23 bp, Homo sapiens
tgactgcccagaaccctgctcat

SEQ ID NO: 34852 - DNA, 23 bp, Homo sapiens
caggagccccagccccccaggag

SEQ ID NO: 34853 - DNA, 24 bp, Homo sapiens
tgtaaataattgaagaaaataagg

SEQ ID NO: 34854 - DNA, 24 bp, Homo sapiens
atgtaaataattgaagaaaataag

SEQ ID NO: 34855 - DNA, 24 bp, Homo sapiens
tatgtaaataattgaagaaaataa

SEQ ID NO: 34856 - DNA, 24 bp, Homo sapiens
ctcaggttgaccaggctgctcttg

SEQ ID NO: 34857 - DNA, 24 bp, Homo sapiens
tctttgttaaaggctgtgtggctg

SEQ ID NO: 34858 - DNA, 24 bp, Homo sapiens
cttatatcaatgaaagcaatgaca

SEQ ID NO: 34859 - DNA, 24 bp, Homo sapiens
gggctgagaagctgcagaaagagc

SEQ ID NO: 34860 - DNA, 24 bp, Homo sapiens
ggggctgagaagctgcagaaagag

SEQ ID NO: 34861 - DNA, 24 bp, Homo sapiens
cggggctgagaagctgcagaaaga

SEQ ID NO: 34862 - DNA, 24 bp, Homo sapiens
acagcagcgtggtcagagtggtag

SEQ ID NO: 34863 - DNA, 24 bp, Homo sapiens
gtgctagagcttgtggaccactgg

SEQ ID NO: 34864 - DNA, 24 bp, Homo sapiens
gttggtggtggcggtgacagagtg

SEQ ID NO: 34865 - DNA, 24 bp, Homo sapiens
ggcttgtccacttgatccagcgac

SEQ ID NO: 34866 - DNA, 24 bp, Homo sapiens
ctcgctgtgagtgtgagcataaca

SEQ ID NO: 34867 - DNA, 24 bp, Homo sapiens
tcagtgctgtccaggattccatca

SEQ ID NO: 34868 - DNA, 24 bp, Homo sapiens
aagccagacaagccaacgacacag

SEQ ID NO: 34869 - DNA, 24 bp, Homo sapiens
aaactagcagacagcgtcgccaaa

SEQ ID NO: 34870 - DNA, 24 bp, Homo sapiens
agaacctcgatggcctgaagaaga

SEQ ID NO: 34871 - DNA, 24 bp, Homo sapiens
ttccaagaacaatcaaagtatctg

SEQ ID NO: 34872 - DNA, 24 bp, Homo sapiens
cttccaagaacaatcaaagtatct

SEQ ID NO: 34873 - DNA, 24 bp, Homo sapiens
ccttccaagaacaatcaaagtatc

SEQ ID NO: 34874 - DNA, 24 bp, Homo sapiens
gcactgtcagtcctcaggtggaag

SEQ ID NO: 34875 - DNA, 24 bp, Homo sapiens
tctccactgtcatgttcaagttca

SEQ ID NO: 34876 - DNA, 24 bp, Homo sapiens
atcttgccacacgagacctgagag

SEQ ID NO: 34877 - DNA, 24 bp, Homo sapiens
atattttgctcgtaagtaatcttg

SEQ ID NO: 34878 - DNA, 24 bp, Homo sapiens
aatattttgctcgtaagtaatctt

SEQ ID NO: 34879 - DNA, 24 bp, Homo sapiens
caatattttgctcgtaagtaatct

SEQ ID NO: 34880 - DNA, 24 bp, Homo sapiens
tctgattttagactgcataaacca

SEQ ID NO: 34881 - DNA, 24 bp, Homo sapiens
ttctgattttagactgcataaacc

SEQ ID NO: 34882 - DNA, 24 bp, Homo sapiens
tttctgattttagactgcataaac

SEQ ID NO: 34883 - DNA, 24 bp, Homo sapiens
tgtggcagtgacccctaacctctc

SEQ ID NO: 34884 - DNA, 24 bp, Homo sapiens
gacacagccacagccctccaacgg

SEQ ID NO: 34885 - DNA, 24 bp, Homo sapiens
ccttcgggaccagtaccacctcat

SEQ ID NO: 34886 - DNA, 23 bp, Homo sapiens
gcggagatgaggtcggcagcggc

SEQ ID NO: 34887 - DNA, 23 bp, Homo sapiens
agaagccttcagaactccttgca

SEQ ID NO: 34888 - DNA, 25 bp, Homo sapiens
cgacatcctggagttgagcgtgaag

SEQ ID NO: 34889 - DNA, 24 bp, Homo sapiens
tccaagaaactctcattgccacct

SEQ ID NO: 34890 - DNA, 24 bp, Homo sapiens
agagcaatagagcacgcctatcaa

SEQ ID NO: 34891 - DNA, 24 bp, Homo sapiens
gaacagccaacagccgccaagagt

SEQ ID NO: 34892 - DNA, 24 bp, Homo sapiens
tttggtgccaagtgatatttattc

SEQ ID NO: 34893 - DNA, 24 bp, Homo sapiens
ttttggtgccaagtgatatttatt

SEQ ID NO: 34894 - DNA, 24 bp, Homo sapiens
attttggtgccaagtgatatttat

SEQ ID NO: 34895 - DNA, 24 bp, Homo sapiens
gccgactggtaattgatggtctcc

SEQ ID NO: 34896 - DNA, 24 bp, Homo sapiens
tccattcgtctgagaactcgttcc

SEQ ID NO: 34897 - DNA, 24 bp, Homo sapiens
gaacagccaacagccgccaagagt

SEQ ID NO: 34898 - DNA, 24 bp, Homo sapiens
ctttttatcagatggcagtttctg

SEQ ID NO: 34899 - DNA, 24 bp, Homo sapiens
tctttttatcagatggcagtttct

SEQ ID NO: 34900 - DNA, 24 bp, Homo sapiens
ttctttttatcagatggcagtttc

SEQ ID NO: 34901 - DNA, 24 bp, Homo sapiens
aataatagcagacttaaaacaatc

SEQ ID NO: 34902 - DNA, 24 bp, Homo sapiens
gaataatagcagacttaaaacaat

SEQ ID NO: 34903 - DNA, 24 bp, Homo sapiens
agaataatagcagacttaaaacaa

SEQ ID NO: 34904 - DNA, 24 bp, Homo sapiens
cttctgtccacatggctacggctg

SEQ ID NO: 34905 - DNA, 24 bp, Homo sapiens
cggtggctctggctggattatgta

SEQ ID NO: 34906 - DNA, 24 bp, Homo sapiens
cctatgacttcatcagccactgcg

SEQ ID NO: 34907 - DNA, 24 bp, Homo sapiens
cggtctacgtcaaggtcaagagcg

SEQ ID NO: 34908 - DNA, 23 bp, Homo sapiens
caccgccgccgccgcctgcgaag

SEQ ID NO: 34909 - DNA, 23 bp, Homo sapiens
cgcagaacgtcagccgctccctg

SEQ ID NO: 34910 - DNA, 24 bp, Homo sapiens
atctgaaaatggtgtggaaaatgt

SEQ ID NO: 34911 - DNA, 24 bp, Homo sapiens
aatctgaaaatggtgtggaaaatg

SEQ ID NO: 34912 - DNA, 24 bp, Homo sapiens
caatctgaaaatggtgtggaaaat

SEQ ID NO: 34913 - DNA, 24 bp, Homo sapiens
cctgttccgagactgaatgtggcg

SEQ ID NO: 34914 - DNA, 24 bp, Homo sapiens
tgacgaaggagagaggaagtgtgg

SEQ ID NO: 34915 - DNA, 24 bp, Homo sapiens
tggctgtggtggtctggttactgt

SEQ ID NO: 34916 - DNA, 24 bp, Homo sapiens
cctggctgtggtggtctggttact

SEQ ID NO: 34917 - DNA, 24 bp, Homo sapiens
cctgttccgagactgaatgtggcg

SEQ ID NO: 34918 - DNA, 24 bp, Homo sapiens
gcagaactgacgaaggagagagga

SEQ ID NO: 34919 - DNA, 24 bp, Homo sapiens
cacctcagtgtcaccgcttcacag

SEQ ID NO: 34920 - DNA, 24 bp, Homo sapiens
aatctttcctgcctgccatccctg

SEQ ID NO: 34921 - DNA, 24 bp, Homo sapiens
gggtgtgctgggtgcctttgagag

SEQ ID NO: 34922 - DNA, 24 bp, Homo sapiens
gggctgggcagtgtggctagcttg

SEQ ID NO: 34923 - DNA, 24 bp, Homo sapiens
tgggctgggcagtgtggctagctt

SEQ ID NO: 34924 - DNA, 24 bp, Homo sapiens
ctgggctgggcagtgtggctagct

SEQ ID NO: 34925 - DNA, 24 bp, Homo sapiens
acctgaaagaggtgagattattat

SEQ ID NO: 34926 - DNA, 24 bp, Homo sapiens
gacctgaaagaggtgagattatta

SEQ ID NO: 34927 - DNA, 24 bp, Homo sapiens
agacctgaaagaggtgagattatt

SEQ ID NO: 34928 - DNA, 24 bp, Homo sapiens
ttaatgtttagatcttttaccgtc

SEQ ID NO: 34929 - DNA, 24 bp, Homo sapiens
tttaatgtttagatcttttaccgt

SEQ ID NO: 34930 - DNA, 24 bp, Homo sapiens
tttaatgtttagatcttttaccgt

SEQ ID NO: 34931 - DNA, 24 bp, Homo sapiens
cagacgctcaggagcaagtgagta

SEQ ID NO: 34932 - DNA, 24 bp, Homo sapiens
gcagacgctcaggagcaagtgagt

SEQ ID NO: 34933 - DNA, 24 bp, Homo sapiens
agcagacgctcaggagcaagtgag

SEQ ID NO: 34934 - DNA, 23 bp, Homo sapiens
gatgtggacctgctgctgctgct

SEQ ID NO: 34935 - DNA, 25 bp, Homo sapiens
ggacaccgctaatcagcttctctgc

SEQ ID NO: 34936 - DNA, 23 bp, Homo sapiens
cctgctcctacacatccacatgc

SEQ ID NO: 34937 - DNA, 24 bp, Homo sapiens
cgcctggactacatcacgtaccgc

SEQ ID NO: 34938 - DNA, 24 bp, Homo sapiens
caggaggtggagcaggtgacgttc

SEQ ID NO: 34939 - DNA, 24 bp, Homo sapiens
gctccgagtctcagtgtcctccta

SEQ ID NO: 34940 - DNA, 24 bp, Homo sapiens
ggctgttcatcaccttccacctcc

SEQ ID NO: 34941 - DNA, 23 bp, Homo sapiens
gtgtggctgtggtcgtggtctgc

SEQ ID NO: 34942 - DNA, 24 bp, Homo sapiens
attgaacacttgaagaacggcagc

SEQ ID NO: 34943 - DNA, 24 bp, Homo sapiens
gaccaaaaagagtaaaacctttta

SEQ ID NO: 34944 - DNA, 24 bp, Homo sapiens
agaccaaaaagagtaaaacctttt

SEQ ID NO: 34945 - DNA, 24 bp, Homo sapiens
gagaccaaaaagagtaaaaccttt

SEQ ID NO: 34946 - DNA, 24 bp, Homo sapiens
actgaggttgaaactttcggcttt

SEQ ID NO: 34947 - DNA, 24 bp, Homo sapiens
tgtcaccatttctacctgccacgc

SEQ ID NO: 34948 - DNA, 24 bp, Homo sapiens
aggttgggactcgactggtgtttg

SEQ ID NO: 34949 - DNA, 24 bp, Homo sapiens
aattctgacaactctaagccaaag

SEQ ID NO: 34950 - DNA, 24 bp, Homo sapiens
caattctgacaactctaagccaaa

SEQ ID NO: 34951 - DNA, 24 bp, Homo sapiens
tcaattctgacaactctaagccaa

SEQ ID NO: 34952 - DNA, 23 bp, Homo sapiens
ctgccaccacctcctcctcctcc

SEQ ID NO: 34953 - DNA, 24 bp, Homo sapiens
aaacaacaggagagtgcccaacgg

SEQ ID NO: 34954 - DNA, 24 bp, Homo sapiens
aagacagttcccgaccttctaccc

SEQ ID NO: 34955 - DNA, 24 bp, Homo sapiens
tgatgtttaagggtgaaatctttc

SEQ ID NO: 34956 - DNA, 24 bp, Homo sapiens
gtgatgtttaagggtgaaatcttt

SEQ ID NO: 34957 - DNA, 24 bp, Homo sapiens
ggtgatgtttaagggtgaaatctt

SEQ ID NO: 34958 - DNA, 24 bp, Homo sapiens
tttaaaaaaagtaatagcgctgaa

SEQ ID NO: 34959 - DNA, 24 bp, Homo sapiens
ctttaaaaaaagtaatagcgctga

SEQ ID NO: 34960 - DNA, 24 bp, Homo sapiens
ctttaaaaaaagtaatagcgctga

SEQ ID NO: 34961 - DNA, 24 bp, Homo sapiens
acctcatggactgctgtgacacag

SEQ ID NO: 34962 - DNA, 24 bp, Homo sapiens
gacctcatggactgctgtgacaca

SEQ ID NO: 34963 - DNA, 24 bp, Homo sapiens
ggacctcatggactgctgtgacac

SEQ ID NO: 34964 - DNA, 24 bp, Homo sapiens
cgctgaggtggagctggaatactc

SEQ ID NO: 34965 - DNA, 24 bp, Homo sapiens
gagccgtccctcctgtcgcccttg

SEQ ID NO: 34966 - DNA, 24 bp, Homo sapiens
cgcctgagtcacattgcagaggac

SEQ ID NO: 34967 - DNA, 24 bp, Homo sapiens
tggctacaggtgatctggaccaag

SEQ ID NO: 34968 - DNA, 24 bp, Homo sapiens
gcttgcttgcctttgcctgggtat

SEQ ID NO: 34969 - DNA, 24 bp, Homo sapiens
tggcaatggatacatcagcttcaa

SEQ ID NO: 34970 - DNA, 24 bp, Homo sapiens
cagaaatgaaggactcaaaagctt

SEQ ID NO: 34971 - DNA, 24 bp, Homo sapiens
gcagaaatgaaggactcaaaagct

SEQ ID NO: 34972 - DNA, 24 bp, Homo sapiens
agcagaaatgaaggactcaaaagc

SEQ ID NO: 34973 - DNA, 24 bp, Homo sapiens
catttgtacagcttgagaattgta

SEQ ID NO: 34974 - DNA, 24 bp, Homo sapiens
tcatttgtacagcttgagaattgt

SEQ ID NO: 34975 - DNA, 24 bp, Homo sapiens
atcatttgtacagcttgagaattg

SEQ ID NO: 34976 - DNA, 24 bp, Homo sapiens
tatcctaacagaatttatttatgt

SEQ ID NO: 34977 - DNA, 24 bp, Homo sapiens
atatcctaacagaatttatttatg

SEQ ID NO: 34978 - DNA, 24 bp, Homo sapiens
aatatcctaacagaatttatttat

SEQ ID NO: 34979 - DNA, 24 bp, Homo sapiens
ttatatccatgatgatattgaaaa

SEQ ID NO: 34980 - DNA, 24 bp, Homo sapiens
attatatccatgatgatattgaaa

SEQ ID NO: 34981 - DNA, 24 bp, Homo sapiens
tattatatccatgatgatattgaa

SEQ ID NO: 34982 - DNA, 24 bp, Homo sapiens
cagagattgtggcaaaggaagcac

SEQ ID NO: 34983 - DNA, 24 bp, Homo sapiens
ccagagattgtggcaaaggaagca

SEQ ID NO: 34984 - DNA, 24 bp, Homo sapiens
cccagagattgtggcaaaggaagc

SEQ ID NO: 34985 - DNA, 24 bp, Homo sapiens
ggatcctgctcatctcagctgtgc

SEQ ID NO: 34986 - DNA, 24 bp, Homo sapiens
ctcccgccgccgcctcggtacacc

SEQ ID NO: 34987 - DNA, 24 bp, Homo sapiens
gcgcccgagcacatggcgtccatc

SEQ ID NO: 34988 - DNA, 24 bp, Homo sapiens
agtttctgctgcctgttgctgtga

SEQ ID NO: 34989 - DNA, 24 bp, Homo sapiens
ccgttccttgtgttcgtggtggtg

SEQ ID NO: 34990 - DNA, 24 bp, Homo sapiens
cgcagaggtggtggtgaagaagtc

SEQ ID NO: 34991 - DNA, 24 bp, Homo sapiens
gggaccgagccacagccagaaatg

SEQ ID NO: 34992 - DNA, 24 bp, Homo sapiens
tcagagaccttgaaggacactgcc

SEQ ID NO: 34993 - DNA, 24 bp, Homo sapiens
cactcaccaaggagaaggaggagc

SEQ ID NO: 34994 - DNA, 24 bp, Homo sapiens
agcacctcctcgccagcagccgtc

SEQ ID NO: 34995 - DNA, 24 bp, Homo sapiens
ggagaggactggctgggcaggggc

SEQ ID NO: 34996 - DNA, 24 bp, Homo sapiens
ggagtatttgaggctcggagccac

SEQ ID NO: 34997 - DNA, 24 bp, Homo sapiens
acctgtccatcagcgtgaatgtgc

SEQ ID NO: 34998 - DNA, 24 bp, Homo sapiens
tcatcctgactgccaacctggagg

SEQ ID NO: 34999 - DNA, 24 bp, Homo sapiens
tgagtgtggatgctgagtgtgtgc

SEQ ID NO: 35000 - DNA, 24 bp, Homo sapiens
accaatgaaaccaggagcacccac

SEQ ID NO: 35001 - DNA, 24 bp, Homo sapiens
caagtccctgggctggctgaagag

SEQ ID NO: 35002 - DNA, 24 bp, Homo sapiens
gacctgactgatgccagcgtcgtc

SEQ ID NO: 35003 - DNA, 24 bp, Homo sapiens
gacaccgtccatgacacttcctgg

SEQ ID NO: 35004 - DNA, 23 bp, Homo sapiens
attggggaagataatcggaagag

SEQ ID NO: 35005 - DNA, 24 bp, Homo sapiens
ttcacttcaaagtaagtatcctgc

SEQ ID NO: 35006 - DNA, 24 bp, Homo sapiens
attcacttcaaagtaagtatcctg

SEQ ID NO: 35007 - DNA, 24 bp, Homo sapiens
aattcacttcaaagtaagtatcct

SEQ ID NO: 35008 - DNA, 24 bp, Homo sapiens
aatttcattctcaaactatatgga

SEQ ID NO: 35009 - DNA, 24 bp, Homo sapiens
aaatttcattctcaaactatatgg

SEQ ID NO: 35010 - DNA, 24 bp, Homo sapiens
caaatttcattctcaaactatatg

SEQ ID NO: 35011 - DNA, 24 bp, Homo sapiens
tatatttgcagtttatccccatac

SEQ ID NO: 35012 - DNA, 24 bp, Homo sapiens
ttatatttgcagtttatccccata

SEQ ID NO: 35013 - DNA, 24 bp, Homo sapiens
attatatttgcagtttatccccat

SEQ ID NO: 35014 - DNA, 24 bp, Homo sapiens
tgggaagggcaagacagcagaggc

SEQ ID NO: 35015 - DNA, 24 bp, Homo sapiens
ggagcaaggcatgatcctgaagca

SEQ ID NO: 35016 - DNA, 24 bp, Homo sapiens
tcccgacctggaccgaattatccc

SEQ ID NO: 35017 - DNA, 24 bp, Homo sapiens
cgcccaggagtatgagtttgtgac

SEQ ID NO: 35018 - DNA, 24 bp, Homo sapiens
ctcttcaccgacgatgacaggacg

SEQ ID NO: 35019 - DNA, 24 bp, Homo sapiens
tctgccaggactggaaggactgaa

SEQ ID NO: 35020 - DNA, 24 bp, Homo sapiens
tgtacctaacagtgaagctgctgc

SEQ ID NO: 35021 - DNA, 24 bp, Homo sapiens
tttaactgcaacccagatgatatg

SEQ ID NO: 35022 - DNA, 25 bp, Homo sapiens
gtcattaagactgtttacaacttga

SEQ ID NO: 35023 - DNA, 25 bp, Homo sapiens
agagaagcctgtcattcactgccat

SEQ ID NO: 35024 - DNA, 23 bp, Homo sapiens
aaagtgtgtggctgtgacctggc

SEQ ID NO: 35025 - DNA, 23 bp, Homo sapiens
ggactaccagcggatgtacggga

SEQ ID NO: 35026 - DNA, 25 bp, Homo sapiens
agagaagcctgtcattcactgccat

SEQ ID NO: 35027 - DNA, 23 bp, Homo sapiens
caagggtgaagtgcttcgggtcc

SEQ ID NO: 35028 - DNA, 23 bp, Homo sapiens
aaagtgtgtggctgtgacctggc

SEQ ID NO: 35029 - DNA, 24 bp, Homo sapiens
gtggctggctgctctgattggctg

SEQ ID NO: 35030 - DNA, 24 bp, Homo sapiens
ctgagagctggcactgcgactcga

SEQ ID NO: 35031 - DNA, 24 bp, Homo sapiens
tagtccgagggtggtgggcatccg

SEQ ID NO: 35032 - DNA, 24 bp, Homo sapiens
gggaacgagggagaggttgatcct

SEQ ID NO: 35033 - DNA, 24 bp, Homo sapiens
ccctgccagcccaactgttgtatt

SEQ ID NO: 35034 - DNA, 24 bp, Homo sapiens
tcacattcggattgctcctgctgc

SEQ ID NO: 35035 - DNA, 24 bp, Homo sapiens
cagtttttcttaaattaccaagaa

SEQ ID NO: 35036 - DNA, 24 bp, Homo sapiens
gcagtttttcttaaattaccaaga

SEQ ID NO: 35037 - DNA, 24 bp, Homo sapiens
agcagtttttcttaaattaccaag

SEQ ID NO: 35038 - DNA, 24 bp, Homo sapiens
ccggcctcgaagaatgccaaagag

SEQ ID NO: 35039 - DNA, 24 bp, Homo sapiens
ggaacggagcccgccgaggccgct

SEQ ID NO: 35040 - DNA, 24 bp, Homo sapiens
aggagccacggtcgccggcggtgg

SEQ ID NO: 35041 - DNA, 24 bp, Homo sapiens
tgatggcgaggagaagcagcccgg

SEQ ID NO: 35042 - DNA, 24 bp, Homo sapiens
gtgatggcgaggagaagcagcccg

SEQ ID NO: 35043 - DNA, 24 bp, Homo sapiens
agtgatggcgaggagaagcagccc

SEQ ID NO: 35044 - DNA, 24 bp, Homo sapiens
gccatcaagctctacggagcccca

SEQ ID NO: 35045 - DNA, 24 bp, Homo sapiens
agccatcaagctctacggagcccc

SEQ ID NO: 35046 - DNA, 24 bp, Homo sapiens
gagccatcaagctctacggagccc

SEQ ID NO: 35047 - DNA, 24 bp, Homo sapiens
ttacagaggaggaaactgaggctc

SEQ ID NO: 35048 - DNA, 24 bp, Homo sapiens
ccgcatccttatgaataggtactc

SEQ ID NO: 35049 - DNA, 24 bp, Homo sapiens
catatgctgtgcccttgacagtgg

SEQ ID NO: 35050 - DNA, 24 bp, Homo sapiens
gcaccaggcagccgaggacatgaa

SEQ ID NO: 35051 - DNA, 24 bp, Homo sapiens
tgatgccagtcccaccttctttgc

SEQ ID NO: 35052 - DNA, 24 bp, Homo sapiens
gccatgcctccatcttcaagaagt

SEQ ID NO: 35053 - DNA, 24 bp, Homo sapiens
cagatgaagctacaggtggacgcc

SEQ ID NO: 35054 - DNA, 24 bp, Homo sapiens
cactgcttcctgcctgtagctgag

SEQ ID NO: 35055 - DNA, 23 bp, Homo sapiens
gccgagtcagcagcagcagtgag

SEQ ID NO: 35056 - DNA, 24 bp, Homo sapiens
aatttttaaagcctccagttaagt

SEQ ID NO: 35057 - DNA, 24 bp, Homo sapiens
taatttttaaagcctccagttaag

SEQ ID NO: 35058 - DNA, 24 bp, Homo sapiens
ttaatttttaaagcctccagttaa

SEQ ID NO: 35059 - DNA, 24 bp, Homo sapiens
ccatccaagagttacttccctgaa

SEQ ID NO: 35060 - DNA, 24 bp, Homo sapiens
tccatccaagagttacttccctga

SEQ ID NO: 35061 - DNA, 24 bp, Homo sapiens
ctccatccaagagttacttccctg

SEQ ID NO: 35062 - DNA, 24 bp, Homo sapiens
cttattgcggaaactgccagacgg

SEQ ID NO: 35063 - DNA, 25 bp, Homo sapiens
tcagttggactcaggagcatctggt

SEQ ID NO: 35064 - DNA, 23 bp, Homo sapiens
gccatctctgctgctgccttcca

SEQ ID NO: 35065 - DNA, 24 bp, Homo sapiens
catattttcaggcaatttggtatg

SEQ ID NO: 35066 - DNA, 24 bp, Homo sapiens
acatattttcaggcaatttggtat

SEQ ID NO: 35067 - DNA, 24 bp, Homo sapiens
tacatattttcaggcaatttggta

SEQ ID NO: 35068 - DNA, 24 bp, Homo sapiens
ctgttgcccaggttggagtacagt

SEQ ID NO: 35069 - DNA, 24 bp, Homo sapiens
tctgttgcccaggttggagtacag

SEQ ID NO: 35070 - DNA, 24 bp, Homo sapiens
ctctgttgcccaggttggagtaca

SEQ ID NO: 35071 - DNA, 24 bp, Homo sapiens
ccacaccaccaccaccaccaccac

SEQ ID NO: 35072 - DNA, 24 bp, Homo sapiens
tttacaagggcggctggctggctg

SEQ ID NO: 35073 - DNA, 24 bp, Homo sapiens
gacaccttcggacagcaccctccc

SEQ ID NO: 35074 - DNA, 24 bp, Homo sapiens
gcttctcagtggctctgacagcca

SEQ ID NO: 35075 - DNA, 24 bp, Homo sapiens
tgcttctcagtggctctgacagcc

SEQ ID NO: 35076 - DNA, 24 bp, Homo sapiens
ctgcttctcagtggctctgacagc

SEQ ID NO: 35077 - DNA, 24 bp, Homo sapiens
ggagaatgcagcctaacttgctgg

SEQ ID NO: 35078 - DNA, 24 bp, Homo sapiens
aggagaatgcagcctaacttgctg

SEQ ID NO: 35079 - DNA, 24 bp, Homo sapiens
aaggagaatgcagcctaacttgct

SEQ ID NO: 35080 - DNA, 24 bp, Homo sapiens
ctcagcctcagcctcagcctcagc

SEQ ID NO: 35081 - DNA, 24 bp, Homo sapiens
cctgagagtggcacacctatgggt

SEQ ID NO: 35082 - DNA, 24 bp, Homo sapiens
ccctattgaggagcgtgagagccc

SEQ ID NO: 35083 - DNA, 24 bp, Homo sapiens
cattgagtgggctgctgaggaacg

SEQ ID NO: 35084 - DNA, 24 bp, Homo sapiens
cctctggcaattccttagctctga

SEQ ID NO: 35085 - DNA, 24 bp, Homo sapiens
gcaagaagacaatacagcagagaa

SEQ ID NO: 35086 - DNA, 23 bp, Homo sapiens
acggagtctcgctctgtcaccta

SEQ ID NO: 35087 - DNA, 25 bp, Homo sapiens
ttgtcctacatcctgaagccttgaa

SEQ ID NO: 35088 - DNA, 24 bp, Homo sapiens
cgtctgggtgccttagatttccgc

SEQ ID NO: 35089 - DNA, 23 bp, Homo sapiens
ccggccttccaccatgggatgaa

SEQ ID NO: 35090 - DNA, 23 bp, Homo sapiens
agaaggctcttgccagaggcaga

SEQ ID NO: 35091 - DNA, 23 bp, Homo sapiens
cttggacttcccagcccccagaa

SEQ ID NO: 35092 - DNA, 25 bp, Homo sapiens
acctctctgtgcctcagtttcctca

SEQ ID NO: 35093 - DNA, 25 bp, Homo sapiens
ttgtaatcatgcacctgctcctctg

SEQ ID NO: 35094 - DNA, 23 bp, Homo sapiens
cgtagcaatcaccactcaggagg

SEQ ID NO: 35095 - DNA, 23 bp, Homo sapiens
gccaggagcaagccgagagccag

SEQ ID NO: 35096 - DNA, 23 bp, Homo sapiens
actccgagcagtctctgtccttc

SEQ ID NO: 35097 - DNA, 23 bp, Homo sapiens
cgcatcaccgagtctgaagaggt

SEQ ID NO: 35098 - DNA, 24 bp, Homo sapiens
tccacaccgcagttcccaccgctc

SEQ ID NO: 35099 - DNA, 24 bp, Homo sapiens
gtgtcactcctgcctccagcccag

SEQ ID NO: 35100 - DNA, 24 bp, Homo sapiens
gcggtagccttctctgaactgcgg

SEQ ID NO: 35101 - DNA, 24 bp, Homo sapiens
aatggaacggatttagaagcctgc

SEQ ID NO: 35102 - DNA, 24 bp, Homo sapiens
gttacagacggcggcgagaggaag

SEQ ID NO: 35103 - DNA, 24 bp, Homo sapiens
tttacaagaccagaaatgccacgg

SEQ ID NO: 35104 - DNA, 24 bp, Homo sapiens
gagaccagcagcatcagcatcacc

SEQ ID NO: 35105 - DNA, 24 bp, Homo sapiens
accaagcgtgtagcatcctagtag

SEQ ID NO: 35106 - DNA, 24 bp, Homo sapiens
acccaatgctacacaagaaggact

SEQ ID NO: 35107 - DNA, 24 bp, Homo sapiens
tggaatctgccattgcccttggaa

SEQ ID NO: 35108 - DNA, 24 bp, Homo sapiens
gcctttggactcagactggaactg

SEQ ID NO: 35109 - DNA, 24 bp, Homo sapiens
tcctctcgtggtgacaagatggct

SEQ ID NO: 35110 - DNA, 23 bp, Homo sapiens
ctgcgtccagcgttaccgtggct

SEQ ID NO: 35111 - DNA, 23 bp, Homo sapiens
tggcctctgcagcctcctggtgg

SEQ ID NO: 35112 - DNA, 23 bp, Homo sapiens
agaggccccgagccccgtggatc

SEQ ID NO: 35113 - DNA, 24 bp, Homo sapiens
ccctccttatcacggtcccgctcg

SEQ ID NO: 35114 - DNA, 24 bp, Homo sapiens
ctggcggtgtacatcgacaaggtg

SEQ ID NO: 35115 - DNA, 24 bp, Homo sapiens
caggagaaggaggagctgcgcgag

SEQ ID NO: 35116 - DNA, 24 bp, Homo sapiens
tacagaaagaggttgaagctgtct

SEQ ID NO: 35117 - DNA, 24 bp, Homo sapiens
ctacagaaagaggttgaagctgtc

SEQ ID NO: 35118 - DNA, 24 bp, Homo sapiens
tctacagaaagaggttgaagctgt

SEQ ID NO: 35119 - DNA, 25 bp, Homo sapiens
ctgctacctcagcctcttcagttgc

SEQ ID NO: 35120 - DNA, 25 bp, Homo sapiens
tctcactctgtcactcaggctggaa

SEQ ID NO: 35121 - DNA, 25 bp, Homo sapiens
tgctctccagtatgctgtgtatagt

SEQ ID NO: 35122 - DNA, 24 bp, Homo sapiens
atgctgagtgcctcttggacctga

SEQ ID NO: 35123 - DNA, 24 bp, Homo sapiens
ctgaggcaggagaatcgctggaac

SEQ ID NO: 35124 - DNA, 24 bp, Homo sapiens
gggtatatcgggtggtgctgaggt

SEQ ID NO: 35125 - DNA, 24 bp, Homo sapiens
gaggcggcgatgtattgctttagt

SEQ ID NO: 35126 - DNA, 24 bp, Homo sapiens
ctgctcagcctgtcgatgaagtgc

SEQ ID NO: 35127 - DNA, 24 bp, Homo sapiens
tctccttctcctttggaattggct

SEQ ID NO: 35128 - DNA, 24 bp, Homo sapiens
gaaattaaataagttgaacttcct

SEQ ID NO: 35129 - DNA, 24 bp, Homo sapiens
tgaaattaaataagttgaacttcc

SEQ ID NO: 35130 - DNA, 24 bp, Homo sapiens
ctgaaattaaataagttgaacttc

SEQ ID NO: 35131 - DNA, 24 bp, Homo sapiens
cgtggtggtgtgagcctgtaatcc

SEQ ID NO: 35132 - DNA, 24 bp, Homo sapiens
tgccttctgtctctacggattgcc

SEQ ID NO: 35133 - DNA, 24 bp, Homo sapiens
tgactccagcggtacgaacttcca

SEQ ID NO: 35134 - DNA, 24 bp, Homo sapiens
acgacgatcagattagcctcctcc

SEQ ID NO: 35135 - DNA, 24 bp, Homo sapiens
gagtctcgctctgttgccaggctg

SEQ ID NO: 35136 - DNA, 24 bp, Homo sapiens
aagtgctgggtttacaggcgtgag

SEQ ID NO: 35137 - DNA, 24 bp, Homo sapiens
tgcctacagtcacggaatgccaag

SEQ ID NO: 35138 - DNA, 24 bp, Homo sapiens
ccagcctcttattctccgccatct

SEQ ID NO: 35139 - DNA, 24 bp, Homo sapiens
gcggatcacaaggtcaggagttcg

SEQ ID NO: 35140 - DNA, 24 bp, Homo sapiens
gagacaatagccacgagacagacc

SEQ ID NO: 35141 - DNA, 24 bp, Homo sapiens
tgattctcctgcctcagcctcctg

SEQ ID NO: 35142 - DNA, 24 bp, Homo sapiens
gccagcaacctatctaacacaagc

SEQ ID NO: 35143 - DNA, 24 bp, Homo sapiens
aaatttttcagaggagatgagcat

SEQ ID NO: 35144 - DNA, 24 bp, Homo sapiens
taaatttttcagaggagatgagca

SEQ ID NO: 35145 - DNA, 24 bp, Homo sapiens
taaatttttcagaggagatgagca

SEQ ID NO: 35146 - DNA, 24 bp, Homo sapiens
gagcctgagtgagttctgtggagc

SEQ ID NO: 35147 - DNA, 24 bp, Homo sapiens
tacctgcgattcaagccagcaacc

SEQ ID NO: 35148 - DNA, 24 bp, Homo sapiens
catggtggctcacggctgtaatcc

SEQ ID NO: 35149 - DNA, 24 bp, Homo sapiens
acttaggtgatgtgatataattct

SEQ ID NO: 35150 - DNA, 24 bp, Homo sapiens
cacttaggtgatgtgatataattc

SEQ ID NO: 35151 - DNA, 24 bp, Homo sapiens
gcacttaggtgatgtgatataatt

SEQ ID NO: 35152 - DNA, 24 bp, Homo sapiens
gcactccaactccagcctctagga

SEQ ID NO: 35153 - DNA, 24 bp, Homo sapiens
gacccttaaccaaccctgcttccc

SEQ ID NO: 35154 - DNA, 24 bp, Homo sapiens
ccaggagtcaccaacccgaagttc

SEQ ID NO: 35155 - DNA, 24 bp, Homo sapiens
tgagcggtgagtgaatgtgaaggc

SEQ ID NO: 35156 - DNA, 24 bp, Homo sapiens
gtggtgcttccttgaatctccgct

SEQ ID NO: 35157 - DNA, 24 bp, Homo sapiens
ttctcttgcctcagcctccagact

SEQ ID NO: 35158 - DNA, 24 bp, Homo sapiens
ggcctctctgggacatacatcttt

SEQ ID NO: 35159 - DNA, 24 bp, Homo sapiens
tggcctctctgggacatacatctt

SEQ ID NO: 35160 - DNA, 24 bp, Homo sapiens
atggcctctctgggacatacatct

SEQ ID NO: 35161 - DNA, 23 bp, Homo sapiens
cacttgtcgccacccttccgtag

SEQ ID NO: 35162 - DNA, 23 bp, Homo sapiens
ctgcctgagtgacctagccgctg

SEQ ID NO: 35163 - DNA, 25 bp, Homo sapiens
cgtgagagagtgtcttcttccctga

SEQ ID NO: 35164 - DNA, 25 bp, Homo sapiens
accgtgatgtgatgctggagaactt

SEQ ID NO: 35165 - DNA, 23 bp, Homo sapiens
gctccttgatgaggctcagaggc

SEQ ID NO: 35166 - DNA, 25 bp, Homo sapiens
gcctctctgggacatacatctttca

SEQ ID NO: 35167 - DNA, 24 bp, Homo sapiens
ggcggcaccttctaagcagagtat

SEQ ID NO: 35168 - DNA, 24 bp, Homo sapiens
ccaggtcaggattactccagcagg

SEQ ID NO: 35169 - DNA, 24 bp, Homo sapiens
gggagtgttgaggaggcgttgttt

SEQ ID NO: 35170 - DNA, 24 bp, Homo sapiens
tccttccctgtggatgacctggac

SEQ ID NO: 35171 - DNA, 24 bp, Homo sapiens
aattcagccttcagggtctcaaga

SEQ ID NO: 35172 - DNA, 24 bp, Homo sapiens
gagggtgaggtgctgctgatggct

SEQ ID NO: 35173 - DNA, 24 bp, Homo sapiens
gctgacgctcacggttctaactcg

SEQ ID NO: 35174 - DNA, 24 bp, Homo sapiens
tgaggaaaccgaggcacagagagg

SEQ ID NO: 35175 - DNA, 24 bp, Homo sapiens
gggtccaggtcttgagagagtgct

SEQ ID NO: 35176 - DNA, 24 bp, Homo sapiens
gccgactgccagtttgccttcatg

SEQ ID NO: 35177 - DNA, 24 bp, Homo sapiens
cctgaggcgcatactctactccac

SEQ ID NO: 35178 - DNA, 24 bp, Homo sapiens
aacccacggagcccagccagcaag

SEQ ID NO: 35179 - DNA, 24 bp, Homo sapiens
tggggctacaggctggagtgcagt

SEQ ID NO: 35180 - DNA, 24 bp, Homo sapiens
ctggggctacaggctggagtgcag

SEQ ID NO: 35181 - DNA, 24 bp, Homo sapiens
gctggggctacaggctggagtgca

SEQ ID NO: 35182 - DNA, 24 bp, Homo sapiens
tgggctacaagaaagagacacggt

SEQ ID NO: 35183 - DNA, 24 bp, Homo sapiens
taccagcactttgggagcctgagg

SEQ ID NO: 35184 - DNA, 24 bp, Homo sapiens
ctaggttcactgcaagctccgact

SEQ ID NO: 35185 - DNA, 24 bp, Homo sapiens
tgggctacaagaaagagacacggt

SEQ ID NO: 35186 - DNA, 24 bp, Homo sapiens
ctaggttcactgcaagctccgact

SEQ ID NO: 35187 - DNA, 24 bp, Homo sapiens
cacattctcagctcaccgcaacct

SEQ ID NO: 35188 - DNA, 24 bp, Homo sapiens
cacattctcagctcaccgcaacct

SEQ ID NO: 35189 - DNA, 24 bp, Homo sapiens
cccagtagagacaggatttgccgt

SEQ ID NO: 35190 - DNA, 24 bp, Homo sapiens
acagctctaaccttggtccagaca

SEQ ID NO: 35191 - DNA, 24 bp, Homo sapiens
ctaggttcactgcaagctccgact

SEQ ID NO: 35192 - DNA, 24 bp, Homo sapiens
tgggctacaagaaagagacacggt

SEQ ID NO: 35193 - DNA, 24 bp, Homo sapiens
aagatggaactggaagggttgggc

SEQ ID NO: 35194 - DNA, 24 bp, Homo sapiens
ctgctgtgtgatttgattaataag

SEQ ID NO: 35195 - DNA, 24 bp, Homo sapiens
tctgctgtgtgatttgattaataa

SEQ ID NO: 35196 - DNA, 24 bp, Homo sapiens
ttctgctgtgtgatttgattaata

SEQ ID NO: 35197 - DNA, 24 bp, Homo sapiens
cctcttatttcttccctgccaaca

SEQ ID NO: 35198 - DNA, 24 bp, Homo sapiens
gggtgggtgaatgtcagtagctgg

SEQ ID NO: 35199 - DNA, 24 bp, Homo sapiens
gtaatttgtaatcatagaaacaga

SEQ ID NO: 35200 - DNA, 24 bp, Homo sapiens
aaataaaaatgaggcgaatcttta

SEQ ID NO: 35201 - DNA, 24 bp, Homo sapiens
caaataaaaatgaggcgaatcttt

SEQ ID NO: 35202 - DNA, 24 bp, Homo sapiens
acaaataaaaatgaggcgaatctt

SEQ ID NO: 35203 - DNA, 24 bp, Homo sapiens
caggctgaagtgcagtggtgtcat

SEQ ID NO: 35204 - DNA, 24 bp, Homo sapiens
cctccagcgatcctcctacctcag

SEQ ID NO: 35205 - DNA, 24 bp, Homo sapiens
gggaccgtgggaccaaagaatgac

SEQ ID NO: 35206 - DNA, 24 bp, Homo sapiens
gaagttgcgggaagggagagatgc

SEQ ID NO: 35207 - DNA, 24 bp, Homo sapiens
gtagactggcacagcaccttgtcc

SEQ ID NO: 35208 - DNA, 24 bp, Homo sapiens
gaggactcactggaggaatgtgcc

SEQ ID NO: 35209 - DNA, 24 bp, Homo sapiens
tgacataggcagctcagcagggag

SEQ ID NO: 35210 - DNA, 24 bp, Homo sapiens
ttgacataggcagctcagcaggga

SEQ ID NO: 35211 - DNA, 24 bp, Homo sapiens
gttgacataggcagctcagcaggg

SEQ ID NO: 35212 - DNA, 24 bp, Homo sapiens
ggttcacgccattctcctgcctca

SEQ ID NO: 35213 - DNA, 24 bp, Homo sapiens
tgtggatgggcagtctcgctgtat

SEQ ID NO: 35214 - DNA, 24 bp, Homo sapiens
gtgcagtggcatgatctcagctca

SEQ ID NO: 35215 - DNA, 24 bp, Homo sapiens
ggattcttgtagtgtccaggaatc

SEQ ID NO: 35216 - DNA, 24 bp, Homo sapiens
aggattcttgtagtgtccaggaat

SEQ ID NO: 35217 - DNA, 24 bp, Homo sapiens
gaggattcttgtagtgtccaggaa

SEQ ID NO: 35218 - DNA, 23 bp, Homo sapiens
cacaggcggatggctgcgaattg

SEQ ID NO: 35219 - DNA, 25 bp, Homo sapiens
tcaaccagacgctgaggattcttgt

SEQ ID NO: 35220 - DNA, 25 bp, Homo sapiens
tgatggagacaccttctgagccgaa

SEQ ID NO: 35221 - DNA, 23 bp, Homo sapiens
ccgtcttcctgccctacagccag

SEQ ID NO: 35222 - DNA, 23 bp, Homo sapiens
aacgacactgaggcactggaggt

SEQ ID NO: 35223 - DNA, 25 bp, Homo sapiens
gctctgcctgaagttctctaccagt

SEQ ID NO: 35224 - DNA, 24 bp, Homo sapiens
gccacaacaagaggacataaagat

SEQ ID NO: 35225 - DNA, 24 bp, Homo sapiens
agccacaacaagaggacataaaga

SEQ ID NO: 35226 - DNA, 24 bp, Homo sapiens
tagccacaacaagaggacataaag

SEQ ID NO: 35227 - DNA, 24 bp, Homo sapiens
gccgtggaaaaggaaaaatcttag

SEQ ID NO: 35228 - DNA, 24 bp, Homo sapiens
tgccgtggaaaaggaaaaatctta

SEQ ID NO: 35229 - DNA, 24 bp, Homo sapiens
gtgccgtggaaaaggaaaaatctt

SEQ ID NO: 35230 - DNA, 24 bp, Homo sapiens
atacacatggagttgcctgcctgg

SEQ ID NO: 35231 - DNA, 24 bp, Homo sapiens
acgacgacattatcagccttgcct

SEQ ID NO: 35232 - DNA, 24 bp, Homo sapiens
ggcaggcaaggaggtggtctactt

SEQ ID NO: 35233 - DNA, 24 bp, Homo sapiens
cagaaaaattttgtatttgtgtgg

SEQ ID NO: 35234 - DNA, 24 bp, Homo sapiens
acagaaaaattttgtatttgtgtg

SEQ ID NO: 35235 - DNA, 24 bp, Homo sapiens
cacagaaaaattttgtatttgtgt

SEQ ID NO: 35236 - DNA, 24 bp, Homo sapiens
ttggagccagttcgaggactttct

SEQ ID NO: 35237 - DNA, 24 bp, Homo sapiens
gccaccaccacacaccagcataaa

SEQ ID NO: 35238 - DNA, 24 bp, Homo sapiens
tacttgagaagaacgcctccgcct

SEQ ID NO: 35239 - DNA, 24 bp, Homo sapiens
gcggattgtttacatttggcagcg

SEQ ID NO: 35240 - DNA, 24 bp, Homo sapiens
ccttggcatctcatggtgacgtga

SEQ ID NO: 35241 - DNA, 24 bp, Homo sapiens
ccgagctgctcccgcgccctggcc

SEQ ID NO: 35242 - DNA, 24 bp, Homo sapiens
gtgccgtgagttggagttcttggt

SEQ ID NO: 35243 - DNA, 24 bp, Homo sapiens
tacttgagaagaacgcctccgcct

SEQ ID NO: 35244 - DNA, 24 bp, Homo sapiens
gccaccaccacacaccagcataaa

SEQ ID NO: 35245 - DNA, 23 bp, Homo sapiens
cttgtggctggcttgcggttgct

SEQ ID NO: 35246 - DNA, 24 bp, Homo sapiens
acgatggaatcagacaacggctgc

SEQ ID NO: 35247 - DNA, 23 bp, Homo sapiens
ggcagcacccaggcacctctcag

SEQ ID NO: 35248 - DNA, 24 bp, Homo sapiens
cgcatccgcaccacgttcaccagc

SEQ ID NO: 35249 - DNA, 24 bp, Homo sapiens
cccactaccccgacatttacacgc

SEQ ID NO: 35250 - DNA, 24 bp, Homo sapiens
ctggcgctcaagatcgacctcact

SEQ ID NO: 35251 - DNA, 23 bp, Homo sapiens
gctacctcaagtgcctgtaccaa

SEQ ID NO: 35252 - DNA, 25 bp, Homo sapiens
tcccaaacagcagagaacttcccag

SEQ ID NO: 35253 - DNA, 24 bp, Homo sapiens
ggtagaggtccttcagagctgcgt

SEQ ID NO: 35254 - DNA, 23 bp, Homo sapiens
gtcttgctctgtcacccaggctg

SEQ ID NO: 35255 - DNA, 24 bp, Homo sapiens
ggattacaggcgtgagccaccgcg

SEQ ID NO: 35256 - DNA, 24 bp, Homo sapiens
gggattacaggcgtgagccaccgc

SEQ ID NO: 35257 - DNA, 24 bp, Homo sapiens
tgggattacaggcgtgagccaccg

SEQ ID NO: 35258 - DNA, 24 bp, Homo sapiens
aaatgaaaaggcataagaatgttt

SEQ ID NO: 35259 - DNA, 24 bp, Homo sapiens
aaaatgaaaaggcataagaatgtt

SEQ ID NO: 35260 - DNA, 24 bp, Homo sapiens
gaaaatgaaaaggcataagaatgt

SEQ ID NO: 35261 - DNA, 24 bp, Homo sapiens
ggcacacgaagcctgttaatatga

SEQ ID NO: 35262 - DNA, 24 bp, Homo sapiens
cggcacacgaagcctgttaatatg

SEQ ID NO: 35263 - DNA, 24 bp, Homo sapiens
gcggcacacgaagcctgttaatat

SEQ ID NO: 35264 - DNA, 24 bp, Homo sapiens
ctgctgctgctgctgctgagtctg

SEQ ID NO: 35265 - DNA, 24 bp, Homo sapiens
cgcgtgccggtccccgatgtcacc

SEQ ID NO: 35266 - DNA, 24 bp, Homo sapiens
ctgctgctgctgctgctgagtctg

SEQ ID NO: 35267 - DNA, 24 bp, Homo sapiens
acgcggaacgtctgccggtgtccc

SEQ ID NO: 35268 - DNA, 24 bp, Homo sapiens
ccgcgtgccggtccccgatgtcac

SEQ ID NO: 35269 - DNA, 23 bp, Homo sapiens
agcctttctggaccatctcgtgc

SEQ ID NO: 35270 - DNA, 24 bp, Homo sapiens
agtctcactctgtcacccaggctg

SEQ ID NO: 35271 - DNA, 23 bp, Homo sapiens
ctcctgacctcaagtgatccgcc

SEQ ID NO: 35272 - DNA, 24 bp, Homo sapiens
caaaatggcagtaaaaattagaga

SEQ ID NO: 35273 - DNA, 24 bp, Homo sapiens
acaaaatggcagtaaaaattagag

SEQ ID NO: 35274 - DNA, 24 bp, Homo sapiens
gacaaaatggcagtaaaaattaga

SEQ ID NO: 35275 - DNA, 24 bp, Homo sapiens
taccataataaaaaaagaccgtga

SEQ ID NO: 35276 - DNA, 24 bp, Homo sapiens
ttaccataataaaaaaagaccgtg

SEQ ID NO: 35277 - DNA, 24 bp, Homo sapiens
attaccataataaaaaaagaccgt

SEQ ID NO: 35278 - DNA, 24 bp, Homo sapiens
ggatggatggtcctgtgcttaacc

SEQ ID NO: 35279 - DNA, 24 bp, Homo sapiens
cctgataacaacagagtgacagca

SEQ ID NO: 35280 - DNA, 24 bp, Homo sapiens
tggctggtattcaagggtccaaga

SEQ ID NO: 35281 - DNA, 24 bp, Homo sapiens
gaatattctagtgagagaagctgc

SEQ ID NO: 35282 - DNA, 24 bp, Homo sapiens
tgaatattctagtgagagaagctg

SEQ ID NO: 35283 - DNA, 24 bp, Homo sapiens
ttgaatattctagtgagagaagct

SEQ ID NO: 35284 - DNA, 24 bp, Homo sapiens
ctttattacagtgactcagaacac

SEQ ID NO: 35285 - DNA, 24 bp, Homo sapiens
cctttattacagtgactcagaaca

SEQ ID NO: 35286 - DNA, 24 bp, Homo sapiens
tcctttattacagtgactcagaac

SEQ ID NO: 35287 - DNA, 24 bp, Homo sapiens
caattttacagagacatgagagaa

SEQ ID NO: 35288 - DNA, 24 bp, Homo sapiens
tcaattttacagagacatgagaga

SEQ ID NO: 35289 - DNA, 24 bp, Homo sapiens
atcaattttacagagacatgagag

SEQ ID NO: 35290 - DNA, 25 bp, Homo sapiens
ccaatgacaaccaatgatgaaggca

SEQ ID NO: 35291 - DNA, 25 bp, Homo sapiens
ggacaggaactagcctcaatccagc

SEQ ID NO: 35292 - DNA, 23 bp, Homo sapiens
ggattacaggtgtgagccagtgc

SEQ ID NO: 35293 - DNA, 24 bp, Homo sapiens
gctttctgaaggtatcccatattt

SEQ ID NO: 35294 - DNA, 24 bp, Homo sapiens
tgctttctgaaggtatcccatatt

SEQ ID NO: 35295 - DNA, 24 bp, Homo sapiens
atgctttctgaaggtatcccatat

SEQ ID NO: 35296 - DNA, 24 bp, Homo sapiens
ttctttaacaggttgatacgattg

SEQ ID NO: 35297 - DNA, 24 bp, Homo sapiens
tttctttaacaggttgatacgatt

SEQ ID NO: 35298 - DNA, 24 bp, Homo sapiens
ctttctttaacaggttgatacgat

SEQ ID NO: 35299 - DNA, 23 bp, Homo sapiens
gctgctgctgggctgtggacctc

SEQ ID NO: 35300 - DNA, 23 bp, Homo sapiens
gaccctctgtgaacactgacccg

SEQ ID NO: 35301 - DNA, 23 bp, Homo sapiens
cccagcagtgagggctccgatgc

SEQ ID NO: 35302 - DNA, 24 bp, Homo sapiens
aagtctcgctctatcatccaggct

SEQ ID NO: 35303 - DNA, 24 bp, Homo sapiens
attcgctgaaggctctaaggaggc

SEQ ID NO: 35304 - DNA, 24 bp, Homo sapiens
agtgattctcctgcctcagcctcc

SEQ ID NO: 35305 - DNA, 23 bp, Homo sapiens
gagccaccaaacccagcccagaa

SEQ ID NO: 35306 - DNA, 25 bp, Homo sapiens
tgtaacaggatgagcactggtgtcc

SEQ ID NO: 35307 - DNA, 25 bp, Homo sapiens
ggcttctgcttcccttcgtatggtg

SEQ ID NO: 35308 - DNA, 24 bp, Homo sapiens
tctcctttcaggtacacttatagc

SEQ ID NO: 35309 - DNA, 24 bp, Homo sapiens
atctcctttcaggtacacttatag

SEQ ID NO: 35310 - DNA, 24 bp, Homo sapiens
catctcctttcaggtacacttata

SEQ ID NO: 35311 - DNA, 24 bp, Homo sapiens
agaagaaatagagtaccttgtgga

SEQ ID NO: 35312 - DNA, 24 bp, Homo sapiens
aagaagaaatagagtaccttgtgg

SEQ ID NO: 35313 - DNA, 24 bp, Homo sapiens
aaagaagaaatagagtaccttgtg

SEQ ID NO: 35314 - DNA, 24 bp, Homo sapiens
tggccgccccgggctgactttgac

SEQ ID NO: 35315 - DNA, 24 bp, Homo sapiens
gtggccgccccgggctgactttga

SEQ ID NO: 35316 - DNA, 24 bp, Homo sapiens
ggtggccgccccgggctgactttg

SEQ ID NO: 35317 - DNA, 24 bp, Homo sapiens
gaagaatgtcacctgcgagaatgg

SEQ ID NO: 35318 - DNA, 24 bp, Homo sapiens
agccctgacggaccctcaagattc

SEQ ID NO: 35319 - DNA, 24 bp, Homo sapiens
gccgtggtgagttgtgtgcctggg

SEQ ID NO: 35320 - DNA, 24 bp, Homo sapiens
ctcggcgttccagctctcaacctt

SEQ ID NO: 35321 - DNA, 24 bp, Homo sapiens
ccttctgtcggggctctttgttcg

SEQ ID NO: 35322 - DNA, 24 bp, Homo sapiens
gagtctcgcccagccccagcctcc

SEQ ID NO: 35323 - DNA, 24 bp, Homo sapiens
ctaatattcaggtttggtttaaaa

SEQ ID NO: 35324 - DNA, 24 bp, Homo sapiens
tctaatattcaggtttggtttaaa

SEQ ID NO: 35325 - DNA, 24 bp, Homo sapiens
atctaatattcaggtttggtttaa

SEQ ID NO: 35326 - DNA, 24 bp, Homo sapiens
ctcctacttaggtttggtttaaaa

SEQ ID NO: 35327 - DNA, 24 bp, Homo sapiens
tctcctacttaggtttggtttaaa

SEQ ID NO: 35328 - DNA, 24 bp, Homo sapiens
ttctcctacttaggtttggtttaa

SEQ ID NO: 35329 - DNA, 24 bp, Homo sapiens
tggtactggaaggatggcatctgc

SEQ ID NO: 35330 - DNA, 24 bp, Homo sapiens
aactgacaatcatggtggaaggca

SEQ ID NO: 35331 - DNA, 24 bp, Homo sapiens
aaggagcaagagagagcagggcaa

SEQ ID NO: 35332 - DNA, 24 bp, Homo sapiens
gatgtctgtaggaataaaatgtga

SEQ ID NO: 35333 - DNA, 24 bp, Homo sapiens
tgatgtctgtaggaataaaatgtg

SEQ ID NO: 35334 - DNA, 24 bp, Homo sapiens
ctgatgtctgtaggaataaaatgt

SEQ ID NO: 35335 - DNA, 24 bp, Homo sapiens
tggtggaggagcgcctggccggag

SEQ ID NO: 35336 - DNA, 24 bp, Homo sapiens
ctggtggaggagcgcctggccgga

SEQ ID NO: 35337 - DNA, 24 bp, Homo sapiens
gctggtggaggagcgcctggccgg

SEQ ID NO: 35338 - DNA, 24 bp, Homo sapiens
tcttccgtggtaacagtgaacaga

SEQ ID NO: 35339 - DNA, 24 bp, Homo sapiens
tgttctttgtccctatccgtggct

SEQ ID NO: 35340 - DNA, 24 bp, Homo sapiens
aggttgacaaggtagcaggcaggt

SEQ ID NO: 35341 - DNA, 24 bp, Homo sapiens
acccggcccagaagatggaatcgt

SEQ ID NO: 35342 - DNA, 24 bp, Homo sapiens
cacccggcccagaagatggaatcg

SEQ ID NO: 35343 - DNA, 24 bp, Homo sapiens
gcacccggcccagaagatggaatc

SEQ ID NO: 35344 - DNA, 24 bp, Homo sapiens
gtttttgtaaggtatacacagaat

SEQ ID NO: 35345 - DNA, 24 bp, Homo sapiens
tgtttttgtaaggtatacacagaa

SEQ ID NO: 35346 - DNA, 24 bp, Homo sapiens
tgtttttgtaaggtatacacagaa

SEQ ID NO: 35347 - DNA, 24 bp, Homo sapiens
aactaacacaacaaattatcagaa

SEQ ID NO: 35348 - DNA, 24 bp, Homo sapiens
aaactaacacaacaaattatcaga

SEQ ID NO: 35349 - DNA, 24 bp, Homo sapiens
caaactaacacaacaaattatcag

SEQ ID NO: 35350 - DNA, 24 bp, Homo sapiens
ggctggctgtggtggagaatgtag

SEQ ID NO: 35351 - DNA, 24 bp, Homo sapiens
ctcgctcgatgcttctctttgcca

SEQ ID NO: 35352 - DNA, 24 bp, Homo sapiens
cggcattacggcaactatacgtgt

SEQ ID NO: 35353 - DNA, 24 bp, Homo sapiens
ctaaacaggtccactcgcctggga

SEQ ID NO: 35354 - DNA, 24 bp, Homo sapiens
ccctcagccttggtgcccaggccg

SEQ ID NO: 35355 - DNA, 24 bp, Homo sapiens
ctgacccagcccaccacccccgct

SEQ ID NO: 35356 - DNA, 24 bp, Homo sapiens
tcctgcctgcgtgtggtcttcatc

SEQ ID NO: 35357 - DNA, 24 bp, Homo sapiens
catcagcaacggctccttcggcag

SEQ ID NO: 35358 - DNA, 24 bp, Homo sapiens
atcttggcagcaggcaaagtgagc

SEQ ID NO: 35359 - DNA, 24 bp, Homo sapiens
ttagtggtggtcgtggaggtggtt

SEQ ID NO: 35360 - DNA, 24 bp, Homo sapiens
gcaggagaggagagccagagaagt

SEQ ID NO: 35361 - DNA, 24 bp, Homo sapiens
ccgtggtgctggtggatatggtgg

SEQ ID NO: 35362 - DNA, 24 bp, Homo sapiens
ccaacatcgcttcagggacttcgg

SEQ ID NO: 35363 - DNA, 24 bp, Homo sapiens
gagccatccagcccttgattgagc

SEQ ID NO: 35364 - DNA, 24 bp, Homo sapiens
caggcagtgtgggctcttggtaat

SEQ ID NO: 35365 - DNA, 24 bp, Homo sapiens
ccgtaccaaatgctagctctgccc

SEQ ID NO: 35366 - DNA, 23 bp, Homo sapiens
cccaccccatcccccacccgcca

SEQ ID NO: 35367 - DNA, 24 bp, Homo sapiens
agagacagagcagaagacagaacc

SEQ ID NO: 35368 - DNA, 24 bp, Homo sapiens
gttccactggacgctcatcagagg

SEQ ID NO: 35369 - DNA, 24 bp, Homo sapiens
gtgggatttcaagacaagatcggc

SEQ ID NO: 35370 - DNA, 24 bp, Homo sapiens
ccgggataagtagctttagcgatc

SEQ ID NO: 35371 - DNA, 24 bp, Homo sapiens
ccgccgccaccaccaccgccgctg

SEQ ID NO: 35372 - DNA, 24 bp, Homo sapiens
cagccgggcgctgcaagccgccgc

SEQ ID NO: 35373 - DNA, 24 bp, Homo sapiens
gtggtacaaggatgacagactgct

SEQ ID NO: 35374 - DNA, 24 bp, Homo sapiens
cgctcgatgcttctctttgccaac

SEQ ID NO: 35375 - DNA, 24 bp, Homo sapiens
ggctggctgtggtggagaatgtag

SEQ ID NO: 35376 - DNA, 24 bp, Homo sapiens
caacagcagcagcagcagcagcag

SEQ ID NO: 35377 - DNA, 24 bp, Homo sapiens
gggtccctactgcggccggagccc

SEQ ID NO: 35378 - DNA, 23 bp, Homo sapiens
ggctgcttcgcttgcgtgtccaa

SEQ ID NO: 35379 - DNA, 23 bp, Homo sapiens
ccaagagcagcaagaccgacagc

SEQ ID NO: 35380 - DNA, 25 bp, Homo sapiens
gccgagaagaagacgatgaccaacc

SEQ ID NO: 35381 - DNA, 23 bp, Homo sapiens
gactcccgcctccacacacccat

SEQ ID NO: 35382 - DNA, 25 bp, Homo sapiens
atcttctacctgaccctgattggag

SEQ ID NO: 35383 - DNA, 24 bp, Homo sapiens
cctatgaccgctatgtggctgtgt

SEQ ID NO: 35384 - DNA, 24 bp, Homo sapiens
tattaaatctggtaaggaaatacg

SEQ ID NO: 35385 - DNA, 24 bp, Homo sapiens
atattaaatctggtaaggaaatac

SEQ ID NO: 35386 - DNA, 24 bp, Homo sapiens
catattaaatctggtaaggaaata

SEQ ID NO: 35387 - DNA, 24 bp, Homo sapiens
acaaattgatggaaaccaaggacc

SEQ ID NO: 35388 - DNA, 24 bp, Homo sapiens
gacaaattgatggaaaccaaggac

SEQ ID NO: 35389 - DNA, 24 bp, Homo sapiens
agacaaattgatggaaaccaagga

SEQ ID NO: 35390 - DNA, 24 bp, Homo sapiens
cccaaatccagggcctgaacaacg

SEQ ID NO: 35391 - DNA, 24 bp, Homo sapiens
ccccaaatccagggcctgaacaac

SEQ ID NO: 35392 - DNA, 24 bp, Homo sapiens
tccccaaatccagggcctgaacaa

SEQ ID NO: 35393 - DNA, 24 bp, Homo sapiens
caatgcgatggcacggacaactgt

SEQ ID NO: 35394 - DNA, 24 bp, Homo sapiens
ggactgatgaagaggactgtgagc

SEQ ID NO: 35395 - DNA, 24 bp, Homo sapiens
ggacggctctgacgaggaggactg

SEQ ID NO: 35396 - DNA, 24 bp, Homo sapiens
tgtgtctgtgctgatggcttcacg

SEQ ID NO: 35397 - DNA, 24 bp, Homo sapiens
gctctcctttgttgctactgcctg

SEQ ID NO: 35398 - DNA, 24 bp, Homo sapiens
gggagggctctaggtttggtgcta

SEQ ID NO: 35399 - DNA, 24 bp, Homo sapiens
gtctctggcagaaatcaccaagcc

SEQ ID NO: 35400 - DNA, 24 bp, Homo sapiens
tgtctctggcagaaatcaccaagc

SEQ ID NO: 35401 - DNA, 24 bp, Homo sapiens
ttgtctctggcagaaatcaccaag

SEQ ID NO: 35402 - DNA, 23 bp, Homo sapiens
cctgaacgacaagcacctggacg

SEQ ID NO: 35403 - DNA, 23 bp, Homo sapiens
tgtgtcagcagcagcagcagcag

SEQ ID NO: 35404 - DNA, 23 bp, Homo sapiens
tgagcccaccaagaaggaagcgg

SEQ ID NO: 35405 - DNA, 24 bp, Homo sapiens
aaaaagtcctggtaatttctttct

SEQ ID NO: 35406 - DNA, 24 bp, Homo sapiens
gaaaaagtcctggtaatttctttc

SEQ ID NO: 35407 - DNA, 24 bp, Homo sapiens
tgaaaaagtcctggtaatttcttt

SEQ ID NO: 35408 - DNA, 24 bp, Homo sapiens
ttaagtccaagtccgttcgcagcc

SEQ ID NO: 35409 - DNA, 24 bp, Homo sapiens
tgaggcaggagaatcgcttgaacc

SEQ ID NO: 35410 - DNA, 24 bp, Homo sapiens
taggagagtgaccagcagccatgt

SEQ ID NO: 35411 - DNA, 24 bp, Homo sapiens
ggctggggcctgtggtgctgtggc

SEQ ID NO: 35412 - DNA, 24 bp, Homo sapiens
tggctggggcctgtggtgctgtgg

SEQ ID NO: 35413 - DNA, 24 bp, Homo sapiens
gtggctggggcctgtggtgctgtg

SEQ ID NO: 35414 - DNA, 23 bp, Homo sapiens
ggcttagagttctgtcggcggca

SEQ ID NO: 35415 - DNA, 23 bp, Homo sapiens
gttcgccacctatgagaccaagc

SEQ ID NO: 35416 - DNA, 23 bp, Homo sapiens
gatgctgtggctgtgctgctgaa

SEQ ID NO: 35417 - DNA, 24 bp, Homo sapiens
acttgctgtatgttgtggatcggc

SEQ ID NO: 35418 - DNA, 23 bp, Homo sapiens
ggattacagcatggcctcacacc

SEQ ID NO: 35419 - DNA, 24 bp, Homo sapiens
ttctcaggctggtcttgaactcct

SEQ ID NO: 35420 - DNA, 24 bp, Homo sapiens
ctggcacccaggcagcagcaacag

SEQ ID NO: 35421 - DNA, 24 bp, Homo sapiens
gctggcacccaggcagcagcaaca

SEQ ID NO: 35422 - DNA, 24 bp, Homo sapiens
gctggcacccaggcagcagcaaca

SEQ ID NO: 35423 - DNA, 24 bp, Homo sapiens
tggaaactgctggtgctgctggag

SEQ ID NO: 35424 - DNA, 24 bp, Homo sapiens
agacacccggaagcaaagtttggg

SEQ ID NO: 35425 - DNA, 24 bp, Homo sapiens
tgtgggtctttagctgcagagtca

SEQ ID NO: 35426 - DNA, 24 bp, Homo sapiens
ctgtgagaatggcgagtgcgtcaa

SEQ ID NO: 35427 - DNA, 24 bp, Homo sapiens
atgaacagcaccagcagcacggag

SEQ ID NO: 35428 - DNA, 24 bp, Homo sapiens
caccacctacacggaatgctgctg

SEQ ID NO: 35429 - DNA, 24 bp, Homo sapiens
atgacgctcatcggagagaacggc

SEQ ID NO: 35430 - DNA, 24 bp, Homo sapiens
cttccgcgtggtggtgtgccctct

SEQ ID NO: 35431 - DNA, 24 bp, Homo sapiens
catgaatggcggccagtgctcctc

SEQ ID NO: 35432 - DNA, 24 bp, Homo sapiens
ttctgctccttgccaccgtcttct

SEQ ID NO: 35433 - DNA, 24 bp, Homo sapiens
accaggtgtgagaaccaaggtctg

SEQ ID NO: 35434 - DNA, 24 bp, Homo sapiens
gcaaggcagggcacttccagaata

SEQ ID NO: 35435 - DNA, 25 bp, Homo sapiens
gctcgcttccgcatcctagtctcta

SEQ ID NO: 35436 - DNA, 23 bp, Homo sapiens
cctctggctgctggtggcgctgg

SEQ ID NO: 35437 - DNA, 23 bp, Homo sapiens
gcctgctcgcccacttcctcccg

SEQ ID NO: 35438 - DNA, 24 bp, Homo sapiens
ggtgccttcaagtgtctgagagac

SEQ ID NO: 35439 - DNA, 24 bp, Homo sapiens
tggtgccttcaagtgtctgagaga

SEQ ID NO: 35440 - DNA, 24 bp, Homo sapiens
ctggtgccttcaagtgtctgagag

SEQ ID NO: 35441 - DNA, 24 bp, Homo sapiens
aattattatagttgactacaaaga

SEQ ID NO: 35442 - DNA, 24 bp, Homo sapiens
taattattatagttgactacaaag

SEQ ID NO: 35443 - DNA, 24 bp, Homo sapiens
ttaattattatagttgactacaaa

SEQ ID NO: 35444 - DNA, 24 bp, Homo sapiens
taccagaaaataagttaaaagcag

SEQ ID NO: 35445 - DNA, 24 bp, Homo sapiens
ataccagaaaataagttaaaagca

SEQ ID NO: 35446 - DNA, 24 bp, Homo sapiens
aataccagaaaataagttaaaagc

SEQ ID NO: 35447 - DNA, 24 bp, Homo sapiens
acattaccaaagtaagtaaaaact

SEQ ID NO: 35448 - DNA, 24 bp, Homo sapiens
aacattaccaaagtaagtaaaaac

SEQ ID NO: 35449 - DNA, 24 bp, Homo sapiens
aaacattaccaaagtaagtaaaaa

SEQ ID NO: 35450 - DNA, 24 bp, Homo sapiens
tttcttcctaggttactataacaa

SEQ ID NO: 35451 - DNA, 24 bp, Homo sapiens
ttttcttcctaggttactataaca

SEQ ID NO: 35452 - DNA, 24 bp, Homo sapiens
tttttcttcctaggttactataac

SEQ ID NO: 35453 - DNA, 24 bp, Homo sapiens
ccatccgccgcttccttctgtcag

SEQ ID NO: 35454 - DNA, 24 bp, Homo sapiens
tggatggacagggaggttcactac

SEQ ID NO: 35455 - DNA, 24 bp, Homo sapiens
tgaccagatcacagatgttgtcct

SEQ ID NO: 35456 - DNA, 24 bp, Homo sapiens
aggatgactgctgtggctgctgtg

SEQ ID NO: 35457 - DNA, 24 bp, Homo sapiens
gggcacactttcatctaatttggg

SEQ ID NO: 35458 - DNA, 24 bp, Homo sapiens
tgggctgagagtggtgtttgcttt

SEQ ID NO: 35459 - DNA, 24 bp, Homo sapiens
tttactaacaggtgttcaatatga

SEQ ID NO: 35460 - DNA, 24 bp, Homo sapiens
atttactaacaggtgttcaatatg

SEQ ID NO: 35461 - DNA, 24 bp, Homo sapiens
tatttactaacaggtgttcaatat

SEQ ID NO: 35462 - DNA, 23 bp, Homo sapiens
tgtgagccactacacccagcctg

SEQ ID NO: 35463 - DNA, 24 bp, Homo sapiens
aatttcttacagtgagatttgatc

SEQ ID NO: 35464 - DNA, 24 bp, Homo sapiens
aaagggacccgagtgttcaagaag

SEQ ID NO: 35465 - DNA, 24 bp, Homo sapiens
caaagggacccgagtgttcaagaa

SEQ ID NO: 35466 - DNA, 24 bp, Homo sapiens
acaaagggacccgagtgttcaaga

SEQ ID NO: 35467 - DNA, 24 bp, Homo sapiens
tggataaggagatctattaccatg

SEQ ID NO: 35468 - DNA, 24 bp, Homo sapiens
ctggataaggagatctattaccat

SEQ ID NO: 35469 - DNA, 24 bp, Homo sapiens
tctggataaggagatctattacca

SEQ ID NO: 35470 - DNA, 24 bp, Homo sapiens
ggaagtttcttgttcatttgatct

SEQ ID NO: 35471 - DNA, 24 bp, Homo sapiens
tggaagtttcttgttcatttgatc

SEQ ID NO: 35472 - DNA, 24 bp, Homo sapiens
ttggaagtttcttgttcatttgat

SEQ ID NO: 35473 - DNA, 24 bp, Homo sapiens
acaagtaatgatgcctgtctgagc

SEQ ID NO: 35474 - DNA, 24 bp, Homo sapiens
tgatgtgccatagacaaggtggag

SEQ ID NO: 35475 - DNA, 24 bp, Homo sapiens
gaggcttcaggtggctggtcggaa

SEQ ID NO: 35476 - DNA, 23 bp, Homo sapiens
cactaccaccaccaccaccacca

SEQ ID NO: 35477 - DNA, 23 bp, Homo sapiens
ccgtggtgtccgccgtgatcgcc

SEQ ID NO: 35478 - DNA, 23 bp, Homo sapiens
ttgggcggcagcggcgaggagat

SEQ ID NO: 35479 - DNA, 24 bp, Homo sapiens
agggcttccatcgatttctaggca

SEQ ID NO: 35480 - DNA, 24 bp, Homo sapiens
ccgaggctacctcacaggaatggc

SEQ ID NO: 35481 - DNA, 24 bp, Homo sapiens
gaggaggtgaccgtggccgaagtc

SEQ ID NO: 35482 - DNA, 24 bp, Homo sapiens
cagagcagcactgacgaagacctg

SEQ ID NO: 35483 - DNA, 24 bp, Homo sapiens
aagcctgatgaagaccttgaagcc

SEQ ID NO: 35484 - DNA, 24 bp, Homo sapiens
cacaggcgaggaggaggagactac

SEQ ID NO: 35485 - DNA, 23 bp, Homo sapiens
tggctgaccattgatacaggcta

SEQ ID NO: 35486 - DNA, 23 bp, Homo sapiens
ggtgctatgcaagtggagctggt

SEQ ID NO: 35487 - DNA, 23 bp, Homo sapiens
tgaccacagccatcatgcctcgg

SEQ ID NO: 35488 - DNA, 23 bp, Homo sapiens
gtctcaaggttgctcacgccact

SEQ ID NO: 35489 - DNA, 23 bp, Homo sapiens
ctccacccaccaccactgctgct

SEQ ID NO: 35490 - DNA, 24 bp, Homo sapiens
ctcccaaaaaagtaagtactcttg

SEQ ID NO: 35491 - DNA, 24 bp, Homo sapiens
actcccaaaaaagtaagtactctt

SEQ ID NO: 35492 - DNA, 24 bp, Homo sapiens
gactcccaaaaaagtaagtactct

SEQ ID NO: 35493 - DNA, 24 bp, Homo sapiens
gagaagttaagaaacaagttgttc

SEQ ID NO: 35494 - DNA, 24 bp, Homo sapiens
agagaagttaagaaacaagttgtt

SEQ ID NO: 35495 - DNA, 24 bp, Homo sapiens
gagagaagttaagaaacaagttgt

SEQ ID NO: 35496 - DNA, 24 bp, Homo sapiens
ttgctgaaaaggtaatgaatattc

SEQ ID NO: 35497 - DNA, 24 bp, Homo sapiens
tttgctgaaaaggtaatgaatatt

SEQ ID NO: 35498 - DNA, 24 bp, Homo sapiens
ctttgctgaaaaggtaatgaatat

SEQ ID NO: 35499 - DNA, 24 bp, Homo sapiens
cagagtagggcgtgtgtggtggtg

SEQ ID NO: 35500 - DNA, 24 bp, Homo sapiens
cctgtgagcattctgccacctgac

SEQ ID NO: 35501 - DNA, 24 bp, Homo sapiens
gaagctattccgtgtcctcccagg

SEQ ID NO: 35502 - DNA, 24 bp, Homo sapiens
cgaagcgtttcctctccgtgtcat

SEQ ID NO: 35503 - DNA, 24 bp, Homo sapiens
ccgctacatgcaggtctggttctc

SEQ ID NO: 35504 - DNA, 24 bp, Homo sapiens
caccgcacgctgccctcctctgtg

SEQ ID NO: 35505 - DNA, 24 bp, Homo sapiens
agggattacagcctcactctctat

SEQ ID NO: 35506 - DNA, 24 bp, Homo sapiens
cagggattacagcctcactctcta

SEQ ID NO: 35507 - DNA, 24 bp, Homo sapiens
gcagggattacagcctcactctct

SEQ ID NO: 35508 - DNA, 24 bp, Homo sapiens
caatatggaaggtagagtaaaagc

SEQ ID NO: 35509 - DNA, 24 bp, Homo sapiens
tcaatatggaaggtagagtaaaag

SEQ ID NO: 35510 - DNA, 24 bp, Homo sapiens
ctcaatatggaaggtagagtaaaa

SEQ ID NO: 35511 - DNA, 24 bp, Homo sapiens
ggaagtggtgtttagaatgtcagt

SEQ ID NO: 35512 - DNA, 24 bp, Homo sapiens
aggaagtggtgtttagaatgtcag

SEQ ID NO: 35513 - DNA, 24 bp, Homo sapiens
gaggaagtggtgtttagaatgtca

SEQ ID NO: 35514 - DNA, 24 bp, Homo sapiens
ttctctttcagttgcaggagaaat

SEQ ID NO: 35515 - DNA, 24 bp, Homo sapiens
tttctctttcagttgcaggagaaa

SEQ ID NO: 35516 - DNA, 24 bp, Homo sapiens
ttttctctttcagttgcaggagaa

SEQ ID NO: 35517 - DNA, 24 bp, Homo sapiens
agtggaggaagatttacttacagc

SEQ ID NO: 35518 - DNA, 24 bp, Homo sapiens
cagtggaggaagatttacttacag

SEQ ID NO: 35519 - DNA, 24 bp, Homo sapiens
acagtggaggaagatttacttaca

SEQ ID NO: 35520 - DNA, 23 bp, Homo sapiens
gcagcagcagcagcagcagcatc

SEQ ID NO: 35521 - DNA, 25 bp, Homo sapiens
ttcccttccgcttctttctcttcct

SEQ ID NO: 35522 - DNA, 23 bp, Homo sapiens
taagtccgtgagcggtggcagtc

SEQ ID NO: 35523 - DNA, 24 bp, Homo sapiens
gaggtggtaatgttcagattcaga

SEQ ID NO: 35524 - DNA, 24 bp, Homo sapiens
ggaggtggtaatgttcagattcag

SEQ ID NO: 35525 - DNA, 24 bp, Homo sapiens
tggaggtggtaatgttcagattca

SEQ ID NO: 35526 - DNA, 24 bp, Homo sapiens
gccaccaatacttctgctcctgat

SEQ ID NO: 35527 - DNA, 23 bp, Homo sapiens
agctccaccaccccccggctcag

SEQ ID NO: 35528 - DNA, 24 bp, Homo sapiens
cgagaagtacgaataatgaagata

SEQ ID NO: 35529 - DNA, 24 bp, Homo sapiens
atacattagtcagtggctccttgc

SEQ ID NO: 35530 - DNA, 24 bp, Homo sapiens
gaagtggatgtgtggagtctgggc

SEQ ID NO: 35531 - DNA, 24 bp, Homo sapiens
tgttcaccgtgatcttaaggctga

SEQ ID NO: 35532 - DNA, 24 bp, Homo sapiens
agcatagccagccagcctcatctt

SEQ ID NO: 35533 - DNA, 24 bp, Homo sapiens
tcttgggagccattcttcttgcct

SEQ ID NO: 35534 - DNA, 24 bp, Homo sapiens
gctgtgtggaatgaggactactgc

SEQ ID NO: 35535 - DNA, 24 bp, Homo sapiens
aacatttgcagaagcaaaccaaac

SEQ ID NO: 35536 - DNA, 24 bp, Homo sapiens
caacatttgcagaagcaaaccaaa

SEQ ID NO: 35537 - DNA, 24 bp, Homo sapiens
tcaacatttgcagaagcaaaccaa

SEQ ID NO: 35538 - DNA, 25 bp, Homo sapiens
tggatggatggaagcaaagtggatt

SEQ ID NO: 35539 - DNA, 25 bp, Homo sapiens
gccttcatttgccagcgacataaca

SEQ ID NO: 35540 - DNA, 25 bp, Homo sapiens
aatgctaccacagttatgcctacca

SEQ ID NO: 35541 - DNA, 23 bp, Homo sapiens
caacctctgcctcctgagttcgg

SEQ ID NO: 35542 - DNA, 24 bp, Homo sapiens
tgggaaaggtttcactgctctcgc

SEQ ID NO: 35543 - DNA, 24 bp, Homo sapiens
atggtctactcatccgtaggctgc

SEQ ID NO: 35544 - DNA, 23 bp, Homo sapiens
tgctggtgctggtgctagtgctg

SEQ ID NO: 35545 - DNA, 23 bp, Homo sapiens
ggtcccaggtgcaggagtggtac

SEQ ID NO: 35546 - DNA, 23 bp, Homo sapiens
atgaggcaggggctgctggtgct

SEQ ID NO: 35547 - DNA, 24 bp, Homo sapiens
tctttctttagggcttaatgtttg

SEQ ID NO: 35548 - DNA, 24 bp, Homo sapiens
ttctttctttagggcttaatgttt

SEQ ID NO: 35549 - DNA, 24 bp, Homo sapiens
tttctttctttagggcttaatgtt

SEQ ID NO: 35550 - DNA, 24 bp, Homo sapiens
ttcttccaaagggcttaatgtttg

SEQ ID NO: 35551 - DNA, 24 bp, Homo sapiens
attcttccaaagggcttaatgttt

SEQ ID NO: 35552 - DNA, 24 bp, Homo sapiens
gattcttccaaagggcttaatgtt

SEQ ID NO: 35553 - DNA, 24 bp, Homo sapiens
ggaccatgactgtgagcaggtgtg

SEQ ID NO: 35554 - DNA, 24 bp, Homo sapiens
cactctgaacagcgacggcaagac

SEQ ID NO: 35555 - DNA, 24 bp, Homo sapiens
acctggtcttcctcattgacggat

SEQ ID NO: 35556 - DNA, 23 bp, Homo sapiens
ctactactgccgctgccaccgtg

SEQ ID NO: 35557 - DNA, 24 bp, Homo sapiens
gattccttcgtctgccagtgctca

SEQ ID NO: 35558 - DNA, 25 bp, Homo sapiens
ggtggattactgcctgctgagtgac

SEQ ID NO: 35559 - DNA, 25 bp, Homo sapiens
tctaatcacggatgtcagcacgagt

SEQ ID NO: 35560 - DNA, 25 bp, Homo sapiens
tgattcctattcctgccactgcctg

SEQ ID NO: 35561 - DNA, 23 bp, Homo sapiens
ctactactgccgctgccaccgtg

SEQ ID NO: 35562 - DNA, 23 bp, Homo sapiens
ggctgctttctgctgatcctcgg

SEQ ID NO: 35563 - DNA, 25 bp, Homo sapiens
ccctcttgctcgccttgaaaatgga

SEQ ID NO: 35564 - DNA, 23 bp, Homo sapiens
cggagacagaggcagaggcagaa

SEQ ID NO: 35565 - DNA, 24 bp, Homo sapiens
tcaaatgtgagaaatgtgaggcag

SEQ ID NO: 35566 - DNA, 24 bp, Homo sapiens
ttcaaatgtgagaaatgtgaggca

SEQ ID NO: 35567 - DNA, 24 bp, Homo sapiens
cttcaaatgtgagaaatgtgaggc

SEQ ID NO: 35568 - DNA, 24 bp, Homo sapiens
cggcagcagcggcagcagtagcag

SEQ ID NO: 35569 - DNA, 24 bp, Homo sapiens
ctctcagccacttccctcccaacc

SEQ ID NO: 35570 - DNA, 24 bp, Homo sapiens
ggagaatggagtagagtcccttgg

SEQ ID NO: 35571 - DNA, 24 bp, Homo sapiens
aaaacagaaaggtaaataatgact

SEQ ID NO: 35572 - DNA, 24 bp, Homo sapiens
gaaaacagaaaggtaaataatgac

SEQ ID NO: 35573 - DNA, 24 bp, Homo sapiens
agaaaacagaaaggtaaataatga

SEQ ID NO: 35574 - DNA, 24 bp, Homo sapiens
tctttttccagaatagtgaaacta

SEQ ID NO: 35575 - DNA, 24 bp, Homo sapiens
ttctttttccagaatagtgaaact

SEQ ID NO: 35576 - DNA, 24 bp, Homo sapiens
tttctttttccagaatagtgaaac

SEQ ID NO: 35577 - DNA, 24 bp, Homo sapiens
aatataactgccttaaaactttaa

SEQ ID NO: 35578 - DNA, 24 bp, Homo sapiens
taatataactgccttaaaacttta

SEQ ID NO: 35579 - DNA, 24 bp, Homo sapiens
ttaatataactgccttaaaacttt

SEQ ID NO: 35580 - DNA, 24 bp, Homo sapiens
aagacaaggtccgaatcgtcatca

SEQ ID NO: 35581 - DNA, 24 bp, Homo sapiens
cgccaagattgctgagagggtgaa

SEQ ID NO: 35582 - DNA, 24 bp, Homo sapiens
cacaagcagcagcagcaatgacat

SEQ ID NO: 35583 - DNA, 24 bp, Homo sapiens
cagagccaacacgaggtcaacgag

SEQ ID NO: 35584 - DNA, 24 bp, Homo sapiens
cgaagcatggaccaagaccagacc

SEQ ID NO: 35585 - DNA, 24 bp, Homo sapiens
ctatccccgaaaaccagtctacca

SEQ ID NO: 35586 - DNA, 24 bp, Homo sapiens
ctgttttgttgggttatagagcgg

SEQ ID NO: 35587 - DNA, 24 bp, Homo sapiens
actgttttgttgggttatagagcg

SEQ ID NO: 35588 - DNA, 24 bp, Homo sapiens
tactgttttgttgggttatagagc

SEQ ID NO: 35589 - DNA, 24 bp, Homo sapiens
ttttatcacagaaggatgattttc

SEQ ID NO: 35590 - DNA, 24 bp, Homo sapiens
tttttatcacagaaggatgatttt

SEQ ID NO: 35591 - DNA, 24 bp, Homo sapiens
ttttttatcacagaaggatgattt

SEQ ID NO: 35592 - DNA, 24 bp, Homo sapiens
tgatatggaaacagcttttgatgg

SEQ ID NO: 35593 - DNA, 24 bp, Homo sapiens
cagtatctgcaactatggaagttt

SEQ ID NO: 35594 - DNA, 24 bp, Homo sapiens
tgggaaaaacatcaattaaaaatg

SEQ ID NO: 35595 - DNA, 24 bp, Homo sapiens
cggcgaggaggacgaggagatgat

SEQ ID NO: 35596 - DNA, 24 bp, Homo sapiens
accaccgcttcaagaacttcctgc

SEQ ID NO: 35597 - DNA, 24 bp, Homo sapiens
ccgtgagagcctggtggtgaacta

SEQ ID NO: 35598 - DNA, 24 bp, Homo sapiens
ctcacagagcccatcatctcacgc

SEQ ID NO: 35599 - DNA, 24 bp, Homo sapiens
tacatcatctacgccaaggagagg

SEQ ID NO: 35600 - DNA, 24 bp, Homo sapiens
aagaatctatggcgacaggcagca

SEQ ID NO: 35601 - DNA, 24 bp, Homo sapiens
ggttcaagccattctcctgcctca

SEQ ID NO: 35602 - DNA, 24 bp, Homo sapiens
acaaccacgaacccagcattgagc

SEQ ID NO: 35603 - DNA, 25 bp, Homo sapiens
acacgtcctcgggtctatcatttgc

SEQ ID NO: 35604 - DNA, 24 bp, Homo sapiens
ttattatcaagattggcagtagcc

SEQ ID NO: 35605 - DNA, 24 bp, Homo sapiens
tttattatcaagattggcagtagc

SEQ ID NO: 35606 - DNA, 24 bp, Homo sapiens
ctttattatcaagattggcagtag

SEQ ID NO: 35607 - DNA, 25 bp, Homo sapiens
ccctggcagatgatgatttcctgac

SEQ ID NO: 35608 - DNA, 23 bp, Homo sapiens
gccgccatcagtgtaaatagagc

SEQ ID NO: 35609 - DNA, 25 bp, Homo sapiens
ggagttcaagaccagcctagccaag

SEQ ID NO: 35610 - DNA, 25 bp, Homo sapiens
cggaatcatacatggctacctgtct

SEQ ID NO: 35611 - DNA, 25 bp, Homo sapiens
acctcctcttgccacccatactatt

SEQ ID NO: 35612 - DNA, 23 bp, Homo sapiens
tactccttctccgatgcctgtga

SEQ ID NO: 35613 - DNA, 24 bp, Homo sapiens
aaataaccaaggttatagctcagc

SEQ ID NO: 35614 - DNA, 24 bp, Homo sapiens
aaaataaccaaggttatagctcag

SEQ ID NO: 35615 - DNA, 24 bp, Homo sapiens
caaaataaccaaggttatagctca

SEQ ID NO: 35616 - DNA, 24 bp, Homo sapiens
ggttcaagcgattctcctgcctca

SEQ ID NO: 35617 - DNA, 24 bp, Homo sapiens
gggattacaggacccaggagggag

SEQ ID NO: 35618 - DNA, 24 bp, Homo sapiens
tgccaggggaagtctcttcgtagg

SEQ ID NO: 35619 - DNA, 24 bp, Homo sapiens
ctccgcctccaggttcaagtgatt

SEQ ID NO: 35620 - DNA, 24 bp, Homo sapiens
gaagtgcagtggtgtgatctcggt

SEQ ID NO: 35621 - DNA, 24 bp, Homo sapiens
tctgcaaggatcatatctaagtgc

SEQ ID NO: 35622 - DNA, 24 bp, Homo sapiens
tacgcctgcagcgccgtgaagaac

SEQ ID NO: 35623 - DNA, 24 bp, Homo sapiens
gtacgcctgcagcgccgtgaagaa

SEQ ID NO: 35624 - DNA, 24 bp, Homo sapiens
agtacgcctgcagcgccgtgaaga

SEQ ID NO: 35625 - DNA, 24 bp, Homo sapiens
gcgtctacgtcctggccaacgagc

SEQ ID NO: 35626 - DNA, 24 bp, Homo sapiens
gggaagaaagtcacggacaagttc

SEQ ID NO: 35627 - DNA, 24 bp, Homo sapiens
gtcgctatggaggagccggagatg

SEQ ID NO: 35628 - DNA, 23 bp, Homo sapiens
gatccgctgtcaacgacgccttg

SEQ ID NO: 35629 - DNA, 23 bp, Homo sapiens
ctccacgccacacagcactacgg

SEQ ID NO: 35630 - DNA, 23 bp, Homo sapiens
tccatgtacggagaccctcacgc

SEQ ID NO: 35631 - DNA, 24 bp, Homo sapiens
tgtttttaaagaaaaaacacaaca

SEQ ID NO: 35632 - DNA, 24 bp, Homo sapiens
ttgtttttaaagaaaaaacacaac

SEQ ID NO: 35633 - DNA, 24 bp, Homo sapiens
tttgtttttaaagaaaaaacacaa

SEQ ID NO: 35634 - DNA, 24 bp, Homo sapiens
aaacaaaattggtaaggaaattaa

SEQ ID NO: 35635 - DNA, 24 bp, Homo sapiens
gaaacaaaattggtaaggaaatta

SEQ ID NO: 35636 - DNA, 24 bp, Homo sapiens
ggaaacaaaattggtaaggaaatt

SEQ ID NO: 35637 - DNA, 23 bp, Homo sapiens
ctgctgctgctgctgctgctgtt

SEQ ID NO: 35638 - DNA, 23 bp, Homo sapiens
ctctggtggtgactctgtgctgc

SEQ ID NO: 35639 - DNA, 23 bp, Homo sapiens
ccacggaggagcgagatgaacca

SEQ ID NO: 35640 - DNA, 23 bp, Homo sapiens
tatctcgcgggcggaagtgggaa

SEQ ID NO: 35641 - DNA, 25 bp, Homo sapiens
cgaaagagaaagaccgtgtctcaaa

SEQ ID NO: 35642 - DNA, 24 bp, Homo sapiens
ccagatcgagccactgcattccag

SEQ ID NO: 35643 - DNA, 25 bp, Homo sapiens
cagacccactcaccctctaccacaa

SEQ ID NO: 35644 - DNA, 25 bp, Homo sapiens
tgcctcagccaagacctactatcgg

SEQ ID NO: 35645 - DNA, 23 bp, Homo sapiens
taccactgtcgcaaccgcaatgt

SEQ ID NO: 35646 - DNA, 24 bp, Homo sapiens
tgattcagggcaccagagatgaca

SEQ ID NO: 35647 - DNA, 24 bp, Homo sapiens
agtgctcaggctggagaagtggat

SEQ ID NO: 35648 - DNA, 24 bp, Homo sapiens
agccctactggagtctcggattct

SEQ ID NO: 35649 - DNA, 24 bp, Homo sapiens
ccttctaaagtgggaacagtggct

SEQ ID NO: 35650 - DNA, 24 bp, Homo sapiens
cctagtgttcaagacctctgctca

SEQ ID NO: 35651 - DNA, 24 bp, Homo sapiens
gggaagactggtggtacatgggag

SEQ ID NO: 35652 - DNA, 24 bp, Homo sapiens
atgagactcatgctggatgaaaaa

SEQ ID NO: 35653 - DNA, 24 bp, Homo sapiens
aatgagactcatgctggatgaaaa

SEQ ID NO: 35654 - DNA, 24 bp, Homo sapiens
aaatgagactcatgctggatgaaa

SEQ ID NO: 35655 - DNA, 24 bp, Homo sapiens
ttcattcgaaagtaagtatctcac

SEQ ID NO: 35656 - DNA, 24 bp, Homo sapiens
cttcattcgaaagtaagtatctca

SEQ ID NO: 35657 - DNA, 24 bp, Homo sapiens
tcttcattcgaaagtaagtatctc

SEQ ID NO: 35658 - DNA, 25 bp, Homo sapiens
ccactatagcgaccagatcgacaac

SEQ ID NO: 35659 - DNA, 23 bp, Homo sapiens
atctggacccgctgccgccgttc

SEQ ID NO: 35660 - DNA, 24 bp, Homo sapiens
cctcttcctgctattcctgcctgc

SEQ ID NO: 35661 - DNA, 24 bp, Homo sapiens
aaaaacacaaggtaggtcttgttg

SEQ ID NO: 35662 - DNA, 24 bp, Homo sapiens
aaaaaacacaaggtaggtcttgtt

SEQ ID NO: 35663 - DNA, 24 bp, Homo sapiens
taaaaaacacaaggtaggtcttgt

SEQ ID NO: 35664 - DNA, 24 bp, Homo sapiens
cgccccggagcaggccaagttcgg

SEQ ID NO: 35665 - DNA, 24 bp, Homo sapiens
cttgggacgcgcctgggcaccggg

SEQ ID NO: 35666 - DNA, 24 bp, Homo sapiens
gaaagggctggcgagtcgaaaggc

SEQ ID NO: 35667 - DNA, 24 bp, Homo sapiens
gttgctgatggtcctcatgctggc

SEQ ID NO: 35668 - DNA, 24 bp, Homo sapiens
gaacaccgacagcagcagcctcac

SEQ ID NO: 35669 - DNA, 24 bp, Homo sapiens
cagcggcttccttgatccttgcca

SEQ ID NO: 35670 - DNA, 24 bp, Homo sapiens
gcttgctctaatgctttctggact

SEQ ID NO: 35671 - DNA, 25 bp, Homo sapiens
agaaaaaagtaaactacttgaaaaa

SEQ ID NO: 35672 - DNA, 24 bp, Homo sapiens
ccctaaggtgtgcctacagagccc

SEQ ID NO: 35673 - DNA, 24 bp, Homo sapiens
gtctggaccgagcaggcagcaaag

SEQ ID NO: 35674 - DNA, 24 bp, Homo sapiens
ccctacagtgtatgtgcagagccc

SEQ ID NO: 35675 - DNA, 24 bp, Homo sapiens
tcctcaacaaggtattttaaatgt

SEQ ID NO: 35676 - DNA, 24 bp, Homo sapiens
gtcctcaacaaggtattttaaatg

SEQ ID NO: 35677 - DNA, 24 bp, Homo sapiens
tgtcctcaacaaggtattttaaat

SEQ ID NO: 35678 - DNA, 24 bp, Homo sapiens
atgaaaaattggtaagagatatta

SEQ ID NO: 35679 - DNA, 24 bp, Homo sapiens
gatgaaaaattggtaagagatatt

SEQ ID NO: 35680 - DNA, 24 bp, Homo sapiens
ggatgaaaaattggtaagagatat

SEQ ID NO: 35681 - DNA, 24 bp, Homo sapiens
cctcacggtgctgtcctgggatgg

SEQ ID NO: 35682 - DNA, 24 bp, Homo sapiens
tgaggtacatctggatggtcagcc

SEQ ID NO: 35683 - DNA, 24 bp, Homo sapiens
acagtgggcagaagatgtcctggg

SEQ ID NO: 35684 - DNA, 24 bp, Homo sapiens
gtaataaaaagatagctgatcagc

SEQ ID NO: 35685 - DNA, 24 bp, Homo sapiens
cgtaataaaaagatagctgatcag

SEQ ID NO: 35686 - DNA, 24 bp, Homo sapiens
acgtaataaaaagatagctgatca

SEQ ID NO: 35687 - DNA, 23 bp, Homo sapiens
tgggttttgctgatgacacaaga

SEQ ID NO: 35688 - DNA, 23 bp, Homo sapiens
tgcctgaagatggaaacactgga

SEQ ID NO: 35689 - DNA, 23 bp, Homo sapiens
actgacctgccctatttgtctgg

SEQ ID NO: 35690 - DNA, 24 bp, Homo sapiens
gcctgtctatcatttcgtgggtcc

SEQ ID NO: 35691 - DNA, 23 bp, Homo sapiens
cactgcctgccacccaccgtctg

SEQ ID NO: 35692 - DNA, 23 bp, Homo sapiens
cctacggcgatgtttcttcaaaa

SEQ ID NO: 35693 - DNA, 24 bp, Homo sapiens
gtgaaaaagaggtaattcatgtct

SEQ ID NO: 35694 - DNA, 24 bp, Homo sapiens
tgtgaaaaagaggtaattcatgtc

SEQ ID NO: 35695 - DNA, 24 bp, Homo sapiens
ctgtgaaaaagaggtaattcatgt

SEQ ID NO: 35696 - DNA, 24 bp, Homo sapiens
gctcctccagtatgacatcacgca

SEQ ID NO: 35697 - DNA, 23 bp, Homo sapiens
ccagcaactcatgcgtgagcaga

SEQ ID NO: 35698 - DNA, 23 bp, Homo sapiens
gagcgcagggagcagcagcagaa

SEQ ID NO: 35699 - DNA, 24 bp, Homo sapiens
taggaaaacaggttattctatatt

SEQ ID NO: 35700 - DNA, 24 bp, Homo sapiens
ttaggaaaacaggttattctatat

SEQ ID NO: 35701 - DNA, 24 bp, Homo sapiens
attaggaaaacaggttattctata

SEQ ID NO: 35702 - DNA, 24 bp, Homo sapiens
aaatctgattgttgcaaaatcatg

SEQ ID NO: 35703 - DNA, 24 bp, Homo sapiens
caaatctgattgttgcaaaatcat

SEQ ID NO: 35704 - DNA, 24 bp, Homo sapiens
gcaaatctgattgttgcaaaatca

SEQ ID NO: 35705 - DNA, 24 bp, Homo sapiens
cagcagcagcagcagcagcagcag

SEQ ID NO: 35706 - DNA, 24 bp, Homo sapiens
gcccaagcaagtcaagcgacagcg

SEQ ID NO: 35707 - DNA, 24 bp, Homo sapiens
tcaacttcagcggctttggctaca

SEQ ID NO: 35708 - DNA, 24 bp, Homo sapiens
caggatgctgaacagcagttttga

SEQ ID NO: 35709 - DNA, 24 bp, Homo sapiens
tgccaccacccaagacagagccag

SEQ ID NO: 35710 - DNA, 24 bp, Homo sapiens
gcggcgagttaacatcgtttttcc

SEQ ID NO: 35711 - DNA, 24 bp, Homo sapiens
cagttaaaaaacaaggagagacag

SEQ ID NO: 35712 - DNA, 24 bp, Homo sapiens
tcagttaaaaaacaaggagagaca

SEQ ID NO: 35713 - DNA, 24 bp, Homo sapiens
ctcagttaaaaaacaaggagagac

SEQ ID NO: 35714 - DNA, 24 bp, Homo sapiens
gtggcgtatggcgtggctatgaat

SEQ ID NO: 35715 - DNA, 24 bp, Homo sapiens
gaggtcccctaccgtgagatcgac

SEQ ID NO: 35716 - DNA, 24 bp, Homo sapiens
gctgcccattccctccacgtgccc

SEQ ID NO: 35717 - DNA, 24 bp, Homo sapiens
atcttttacaggttagtcttgaat

SEQ ID NO: 35718 - DNA, 24 bp, Homo sapiens
catcttttacaggttagtcttgaa

SEQ ID NO: 35719 - DNA, 24 bp, Homo sapiens
acatcttttacaggttagtcttga

SEQ ID NO: 35720 - DNA, 24 bp, Homo sapiens
agagttttaaagaaacatatgtag

SEQ ID NO: 35721 - DNA, 24 bp, Homo sapiens
gagagttttaaagaaacatatgta

SEQ ID NO: 35722 - DNA, 24 bp, Homo sapiens
ggagagttttaaagaaacatatgt

SEQ ID NO: 35723 - DNA, 24 bp, Homo sapiens
ggatcgtgcaggcaacgactttgc

SEQ ID NO: 35724 - DNA, 24 bp, Homo sapiens
aggatcgtgcaggcaacgactttg

SEQ ID NO: 35725 - DNA, 24 bp, Homo sapiens
caggatcgtgcaggcaacgacttt

SEQ ID NO: 35726 - DNA, 24 bp, Homo sapiens
caatttcagaggtaagccaatcaa

SEQ ID NO: 35727 - DNA, 24 bp, Homo sapiens
acaatttcagaggtaagccaatca

SEQ ID NO: 35728 - DNA, 24 bp, Homo sapiens
aacaatttcagaggtaagccaatc

SEQ ID NO: 35729 - DNA, 24 bp, Homo sapiens
gcatccagacttcctcaggcggtg

SEQ ID NO: 35730 - DNA, 24 bp, Homo sapiens
gccgtcgcccatcatcaagttccc

SEQ ID NO: 35731 - DNA, 24 bp, Homo sapiens
agcaggctccaaccaggcggcgag

SEQ ID NO: 35732 - DNA, 24 bp, Homo sapiens
catttttaaagatttgatgagaag

SEQ ID NO: 35733 - DNA, 24 bp, Homo sapiens
tcatttttaaagatttgatgagaa

SEQ ID NO: 35734 - DNA, 24 bp, Homo sapiens
ttcatttttaaagatttgatgaga

SEQ ID NO: 35735 - DNA, 24 bp, Homo sapiens
aaactgttcaggtaaatgaactat

SEQ ID NO: 35736 - DNA, 24 bp, Homo sapiens
aaaactgttcaggtaaatgaacta

SEQ ID NO: 35737 - DNA, 24 bp, Homo sapiens
aaaaactgttcaggtaaatgaact

SEQ ID NO: 35738 - DNA, 25 bp, Homo sapiens
tgctgacgccctatgactactcctc

SEQ ID NO: 35739 - DNA, 23 bp, Homo sapiens
gctgcccaccatcacaccacttt

SEQ ID NO: 35740 - DNA, 23 bp, Homo sapiens
atggaacctgagtgcctcggaca

SEQ ID NO: 35741 - DNA, 24 bp, Homo sapiens
ctattttgtagctcattcaccaac

SEQ ID NO: 35742 - DNA, 24 bp, Homo sapiens
tctattttgtagctcattcaccaa

SEQ ID NO: 35743 - DNA, 24 bp, Homo sapiens
ttctattttgtagctcattcacca

SEQ ID NO: 35744 - DNA, 24 bp, Homo sapiens
tatttttaaagatttgatgaaaat

SEQ ID NO: 35745 - DNA, 24 bp, Homo sapiens
ttatttttaaagatttgatgaaaa

SEQ ID NO: 35746 - DNA, 24 bp, Homo sapiens
tttatttttaaagatttgatgaaa

SEQ ID NO: 35747 - DNA, 24 bp, Homo sapiens
aaatactggaggatttttctactt

SEQ ID NO: 35748 - DNA, 24 bp, Homo sapiens
caaatactggaggatttttctact

SEQ ID NO: 35749 - DNA, 24 bp, Homo sapiens
acaaatactggaggatttttctac

SEQ ID NO: 35750 - DNA, 24 bp, Homo sapiens
tctttttaaaggtatgatgaaagg

SEQ ID NO: 35751 - DNA, 24 bp, Homo sapiens
ttctttttaaaggtatgatgaaag

SEQ ID NO: 35752 - DNA, 24 bp, Homo sapiens
tttctttttaaaggtatgatgaaa

SEQ ID NO: 35753 - DNA, 24 bp, Homo sapiens
ccagacatctcagagccagggacc

SEQ ID NO: 35754 - DNA, 25 bp, Homo sapiens
aatccaacagcagcacccagtttga

SEQ ID NO: 35755 - DNA, 24 bp, Homo sapiens
gaaagccctacatcctgacggtgc

SEQ ID NO: 35756 - DNA, 25 bp, Homo sapiens
aatccaacagcagcacccagtttga

SEQ ID NO: 35757 - DNA, 24 bp, Homo sapiens
gaaagccctacatcctgacggtgc

SEQ ID NO: 35758 - DNA, 23 bp, Homo sapiens
tcaaaggcagagttccaggacgc

SEQ ID NO: 35759 - DNA, 24 bp, Homo sapiens
attttcaaaaggtccacctgacaa

SEQ ID NO: 35760 - DNA, 24 bp, Homo sapiens
tattttcaaaaggtccacctgaca

SEQ ID NO: 35761 - DNA, 24 bp, Homo sapiens
atattttcaaaaggtccacctgac

SEQ ID NO: 35762 - DNA, 23 bp, Homo sapiens
atatcaccgaggctctgagtctc

SEQ ID NO: 35763 - DNA, 25 bp, Homo sapiens
ccgtggactacctgtcacaatatgg

SEQ ID NO: 35764 - DNA, 23 bp, Homo sapiens
gctgtggctgggcttcctactcc

SEQ ID NO: 35765 - DNA, 24 bp, Homo sapiens
agtcaatgcaggtaatcaatcacc

SEQ ID NO: 35766 - DNA, 24 bp, Homo sapiens
gagtcaatgcaggtaatcaatcac

SEQ ID NO: 35767 - DNA, 24 bp, Homo sapiens
agagtcaatgcaggtaatcaatca

SEQ ID NO: 35768 - DNA, 24 bp, Homo sapiens
tgcttcttgctaagttgctccagg

SEQ ID NO: 35769 - DNA, 24 bp, Homo sapiens
agagaccatgccatccatcaccaa

SEQ ID NO: 35770 - DNA, 24 bp, Homo sapiens
tgaaaccatctgagcgagtccctg

SEQ ID NO: 35771 - DNA, 23 bp, Homo sapiens
ctggcacagcgtctctgctccat

SEQ ID NO: 35772 - DNA, 24 bp, Homo sapiens
cttcagtctgcttgccctgagctt

SEQ ID NO: 35773 - DNA, 23 bp, Homo sapiens
cctgctgctggtggtcatctgtg

SEQ ID NO: 35774 - DNA, 24 bp, Homo sapiens
tgagttttttttttttctctaggt

SEQ ID NO: 35775 - DNA, 24 bp, Homo sapiens
atgagttttttttttttctctagg

SEQ ID NO: 35776 - DNA, 24 bp, Homo sapiens
gatgagttttttttttttctctag

SEQ ID NO: 35777 - DNA, 24 bp, Homo sapiens
ggttcacgccattctcctgcctca

SEQ ID NO: 35778 - DNA, 24 bp, Homo sapiens
tggattctgttgttgttggagttg

SEQ ID NO: 35779 - DNA, 24 bp, Homo sapiens
aggagttggctgtatattctggat

SEQ ID NO: 35780 - DNA, 24 bp, Homo sapiens
aatccagtgaacagaagaagaggc

SEQ ID NO: 35781 - DNA, 24 bp, Homo sapiens
gggaccctgaagttggcaccagct

SEQ ID NO: 35782 - DNA, 24 bp, Homo sapiens
gccccccagcagccgcccccaccc

SEQ ID NO: 35783 - DNA, 24 bp, Homo sapiens
ttcacttttaggaaaaaaaaaaaa

SEQ ID NO: 35784 - DNA, 24 bp, Homo sapiens
cttcacttttaggaaaaaaaaaaa

SEQ ID NO: 35785 - DNA, 24 bp, Homo sapiens
cttcacttttaggaaaaaaaaaaa

SEQ ID NO: 35786 - DNA, 23 bp, Homo sapiens
atgctgcggcggcttctgaggtc

SEQ ID NO: 35787 - DNA, 23 bp, Homo sapiens
cgtatcaggcttcatggcggcgc

SEQ ID NO: 35788 - DNA, 23 bp, Homo sapiens
gtgctcccgaagcgggctgcggt

SEQ ID NO: 35789 - DNA, 24 bp, Homo sapiens
catttttaaagggactacaagaaa

SEQ ID NO: 35790 - DNA, 24 bp, Homo sapiens
tcatttttaaagggactacaagaa

SEQ ID NO: 35791 - DNA, 24 bp, Homo sapiens
ttcatttttaaagggactacaaga

SEQ ID NO: 35792 - DNA, 24 bp, Homo sapiens
gcaactcctctgtgaacctactgg

SEQ ID NO: 35793 - DNA, 24 bp, Homo sapiens
cttcactgccaacagccacctgcc

SEQ ID NO: 35794 - DNA, 24 bp, Homo sapiens
gcctcctgggatggatgtcacccg

SEQ ID NO: 35795 - DNA, 24 bp, Homo sapiens
ggctcaagtgatcctcctgactca

SEQ ID NO: 35796 - DNA, 23 bp, Homo sapiens
gcagtggcacgatcatggctcat

SEQ ID NO: 35797 - DNA, 24 bp, Homo sapiens
ggaagaacgctacaggcatggagg

SEQ ID NO: 35798 - DNA, 25 bp, Homo sapiens
ccgcagcatctatttctcaagccca

SEQ ID NO: 35799 - DNA, 23 bp, Homo sapiens
ggttggagttcttcgaccagccg

SEQ ID NO: 35800 - DNA, 23 bp, Homo sapiens
ctagagcagggcagccacacagc

SEQ ID NO: 35801 - DNA, 24 bp, Homo sapiens
ctctgcatctagtgctgggcctca

SEQ ID NO: 35802 - DNA, 24 bp, Homo sapiens
cgtcctgggcctgctgctgctgag

SEQ ID NO: 35803 - DNA, 24 bp, Homo sapiens
aatgtgttgtccaagtcaagcggc

SEQ ID NO: 35804 - DNA, 24 bp, Homo sapiens
ggagcaggacaaataccgcaccat

SEQ ID NO: 35805 - DNA, 24 bp, Homo sapiens
cggcggagtatgaggacggcttct

SEQ ID NO: 35806 - DNA, 25 bp, Homo sapiens
acgaggacatcaaggagaacctgga

SEQ ID NO: 35807 - DNA, 23 bp, Homo sapiens
ccaggtggtggactcccgagcca

SEQ ID NO: 35808 - DNA, 23 bp, Homo sapiens
gcaccgagcccgagccccgagac

SEQ ID NO: 35809 - DNA, 23 bp, Homo sapiens
cccgctcagcctgaccttgcctt

SEQ ID NO: 35810 - DNA, 23 bp, Homo sapiens
tgcagtggcacaatcatggctca

SEQ ID NO: 35811 - DNA, 23 bp, Homo sapiens
cctcaacctcctgggctcaggtg

SEQ ID NO: 35812 - DNA, 24 bp, Homo sapiens
gtggttcggtactgctggctacgc

SEQ ID NO: 35813 - DNA, 24 bp, Homo sapiens
gtggtgctgttgctgctgctgctt

SEQ ID NO: 35814 - DNA, 24 bp, Homo sapiens
cctctcaggtcacgctgtatgtct

SEQ ID NO: 35815 - DNA, 24 bp, Homo sapiens
gatacaaaaaggacaaacaccaaa

SEQ ID NO: 35816 - DNA, 24 bp, Homo sapiens
agatacaaaaaggacaaacaccaa

SEQ ID NO: 35817 - DNA, 24 bp, Homo sapiens
cagatacaaaaaggacaaacacca

SEQ ID NO: 35818 - DNA, 24 bp, Homo sapiens
ttgttttacaggacaaacaccaaa

SEQ ID NO: 35819 - DNA, 24 bp, Homo sapiens
cttgttttacaggacaaacaccaa

SEQ ID NO: 35820 - DNA, 24 bp, Homo sapiens
tcttgttttacaggacaaacacca

SEQ ID NO: 35821 - DNA, 24 bp, Homo sapiens
aacattaatagggctggaaaaaac

SEQ ID NO: 35822 - DNA, 24 bp, Homo sapiens
taacattaatagggctggaaaaaa

SEQ ID NO: 35823 - DNA, 24 bp, Homo sapiens
ataacattaatagggctggaaaaa

SEQ ID NO: 35824 - DNA, 24 bp, Homo sapiens
tggatggatggaagcaaagtggat

SEQ ID NO: 35825 - DNA, 24 bp, Homo sapiens
gccttcatttgccagcgacataac

SEQ ID NO: 35826 - DNA, 24 bp, Homo sapiens
atgctaccacagttatgcctacca

SEQ ID NO: 35827 - DNA, 23 bp, Homo sapiens
gcctcatctacttcttcgtccag

SEQ ID NO: 35828 - DNA, 23 bp, Homo sapiens
cccatcgccgccatcatcatccc

SEQ ID NO: 35829 - DNA, 23 bp, Homo sapiens
ggaacctggtgaaccgcttctcc

SEQ ID NO: 35830 - DNA, 24 bp, Homo sapiens
agcagcacttctcattccaggagg

SEQ ID NO: 35831 - DNA, 24 bp, Homo sapiens
ttgacatcccagaagtggtgtgga

SEQ ID NO: 35832 - DNA, 24 bp, Homo sapiens
gcatgtctctgtaccctggatgta

SEQ ID NO: 35833 - DNA, 24 bp, Homo sapiens
ctgctgctgctcctcaggctgtgg

SEQ ID NO: 35834 - DNA, 24 bp, Homo sapiens
ggttcttatggctgctcccagtgc

SEQ ID NO: 35835 - DNA, 24 bp, Homo sapiens
gtggctcctgtggggggtccaagg

SEQ ID NO: 35836 - DNA, 25 bp, Homo sapiens
ttcagccactcagttggtgatctct

SEQ ID NO: 35837 - DNA, 25 bp, Homo sapiens
aaccagtcttgccgacagcatgatc

SEQ ID NO: 35838 - DNA, 25 bp, Homo sapiens
gcagccatttacaagccaagggaaa

SEQ ID NO: 35839 - DNA, 24 bp, Homo sapiens
ccagagccacggacccaaccgccg

SEQ ID NO: 35840 - DNA, 24 bp, Homo sapiens
cagcccgcggcacctaacctgttc

SEQ ID NO: 35841 - DNA, 24 bp, Homo sapiens
acgcgcacgactcgcgatcttccc

SEQ ID NO: 35842 - DNA, 24 bp, Homo sapiens
aaagttaccagcttgcaaacattt

SEQ ID NO: 35843 - DNA, 24 bp, Homo sapiens
aaaagttaccagcttgcaaacatt

SEQ ID NO: 35844 - DNA, 24 bp, Homo sapiens
taaaagttaccagcttgcaaacat

SEQ ID NO: 35845 - DNA, 24 bp, Homo sapiens
tccagtctccagaactcttccagc

SEQ ID NO: 35846 - DNA, 24 bp, Homo sapiens
ttggagcctactgattctcaagcc

SEQ ID NO: 35847 - DNA, 24 bp, Homo sapiens
ctccgcctcctgtcagatcagtga

SEQ ID NO: 35848 - DNA, 24 bp, Homo sapiens
cagcgagaccaagaacccaccaat

SEQ ID NO: 35849 - DNA, 24 bp, Homo sapiens
caggagggtctgcggcttcattct

SEQ ID NO: 35850 - DNA, 24 bp, Homo sapiens
ggaggaataagcaactctggacac

SEQ ID NO: 35851 - DNA, 24 bp, Homo sapiens
gcagggctccagaactccaaagat

SEQ ID NO: 35852 - DNA, 24 bp, Homo sapiens
cagcgagaccaagaacccaccaat

SEQ ID NO: 35853 - DNA, 24 bp, Homo sapiens
ggaggaataagcaactctggacac

SEQ ID NO: 35854 - DNA, 24 bp, Homo sapiens
agaccttggaccttcggaccttcg

SEQ ID NO: 35855 - DNA, 24 bp, Homo sapiens
ggttcaagcgattctcctgcctca

SEQ ID NO: 35856 - DNA, 24 bp, Homo sapiens
ggtggcactggacttagatgaggc

SEQ ID NO: 35857 - DNA, 24 bp, Homo sapiens
ttctattttaggtatcctgaagca

SEQ ID NO: 35858 - DNA, 24 bp, Homo sapiens
attctattttaggtatcctgaagc

SEQ ID NO: 35859 - DNA, 24 bp, Homo sapiens
attctattttaggtatcctgaagc

SEQ ID NO: 35860 - DNA, 24 bp, Homo sapiens
gcagagagacaggcagccacaccc

SEQ ID NO: 35861 - DNA, 24 bp, Homo sapiens
caggtgctggtgctgctgctgctg

SEQ ID NO: 35862 - DNA, 24 bp, Homo sapiens
acttgtgggaaaggctggcagctc

SEQ ID NO: 35863 - DNA, 24 bp, Homo sapiens
tacaggaacaccagcagctgcagg

SEQ ID NO: 35864 - DNA, 24 bp, Homo sapiens
gtacaggaacaccagcagctgcag

SEQ ID NO: 35865 - DNA, 24 bp, Homo sapiens
tgtacaggaacaccagcagctgca

SEQ ID NO: 35866 - DNA, 24 bp, Homo sapiens
aatgagcacatgacaagaaggcaa

SEQ ID NO: 35867 - DNA, 24 bp, Homo sapiens
ggagaagagtaagccgccatgtga

SEQ ID NO: 35868 - DNA, 24 bp, Homo sapiens
gcatggtagctcacgcctgtaatc

SEQ ID NO: 35869 - DNA, 24 bp, Homo sapiens
tgctgccacaggtggagctgaaga

SEQ ID NO: 35870 - DNA, 24 bp, Homo sapiens
ctgctgccacaggtggagctgaag

SEQ ID NO: 35871 - DNA, 24 bp, Homo sapiens
cctgctgccacaggtggagctgaa

SEQ ID NO: 35872 - DNA, 23 bp, Homo sapiens
ccgtgttagccaggatggtgtcg

SEQ ID NO: 35873 - DNA, 23 bp, Homo sapiens
tgacctcctgatccacccgccat

SEQ ID NO: 35874 - DNA, 25 bp, Homo sapiens
gctccctcctggaaagtagagacga

SEQ ID NO: 35875 - DNA, 24 bp, Homo sapiens
atatttctcagcctggaaagaaag

SEQ ID NO: 35876 - DNA, 24 bp, Homo sapiens
tatatttctcagcctggaaagaaa

SEQ ID NO: 35877 - DNA, 24 bp, Homo sapiens
ttatatttctcagcctggaaagaa

SEQ ID NO: 35878 - DNA, 24 bp, Homo sapiens
tagccttttctgtaagtattttaa

SEQ ID NO: 35879 - DNA, 24 bp, Homo sapiens
ctagccttttctgtaagtatttta

SEQ ID NO: 35880 - DNA, 24 bp, Homo sapiens
tctagccttttctgtaagtatttt

SEQ ID NO: 35881 - DNA, 24 bp, Homo sapiens
gtagaaaaaaagtaagttatcact

SEQ ID NO: 35882 - DNA, 24 bp, Homo sapiens
agtagaaaaaaagtaagttatcac

SEQ ID NO: 35883 - DNA, 24 bp, Homo sapiens
aagtagaaaaaaagtaagttatca

SEQ ID NO: 35884 - DNA, 24 bp, Homo sapiens
cactgtaaaagtgattgctattaa

SEQ ID NO: 35885 - DNA, 24 bp, Homo sapiens
tcactgtaaaagtgattgctatta

SEQ ID NO: 35886 - DNA, 24 bp, Homo sapiens
gtcactgtaaaagtgattgctatt

SEQ ID NO: 35887 - DNA, 24 bp, Homo sapiens
ggttcaagcgattctcctgcctca

SEQ ID NO: 35888 - DNA, 24 bp, Homo sapiens
tgctatggacacagatggcttcac

SEQ ID NO: 35889 - DNA, 24 bp, Homo sapiens
ctgatgttcggatgtgttcggagt

SEQ ID NO: 35890 - DNA, 24 bp, Homo sapiens
ttatatagcaaaaatatgaacctc

SEQ ID NO: 35891 - DNA, 24 bp, Homo sapiens
tttatatagcaaaaatatgaacct

SEQ ID NO: 35892 - DNA, 24 bp, Homo sapiens
ttttatatagcaaaaatatgaacc

SEQ ID NO: 35893 - DNA, 25 bp, Homo sapiens
gcagcacctgaggaaggaactagag

SEQ ID NO: 35894 - DNA, 23 bp, Homo sapiens
cggtggcagcagaggatgagaaa

SEQ ID NO: 35895 - DNA, 25 bp, Homo sapiens
cgtatggagtggaagttagagcagt

SEQ ID NO: 35896 - DNA, 24 bp, Homo sapiens
gtgggatgcaggtggcacggtgca

SEQ ID NO: 35897 - DNA, 24 bp, Homo sapiens
cgtgggatgcaggtggcacggtgc

SEQ ID NO: 35898 - DNA, 24 bp, Homo sapiens
tcgtgggatgcaggtggcacggtg

SEQ ID NO: 35899 - DNA, 24 bp, Homo sapiens
caacttcggcttggaacacggaga

SEQ ID NO: 35900 - DNA, 24 bp, Homo sapiens
ctccccgcatcccagcctctccgc

SEQ ID NO: 35901 - DNA, 24 bp, Homo sapiens
gctgggctcagcacaggtgtgggt

SEQ ID NO: 35902 - DNA, 24 bp, Homo sapiens
ctgtctgctgaggaggtggcttct

SEQ ID NO: 35903 - DNA, 24 bp, Homo sapiens
gtctgctgtcaagtgttcagtggc

SEQ ID NO: 35904 - DNA, 24 bp, Homo sapiens
ggtgacagagcgagactccatcta

SEQ ID NO: 35905 - DNA, 24 bp, Homo sapiens
gctacatctcaactgccgattggg

SEQ ID NO: 35906 - DNA, 24 bp, Homo sapiens
gcaggaatggcagaacgctatcca

SEQ ID NO: 35907 - DNA, 24 bp, Homo sapiens
accagtagcacttccctcaacctg

SEQ ID NO: 35908 - DNA, 24 bp, Homo sapiens
cggcttcgttatctcgttctgagg

SEQ ID NO: 35909 - DNA, 24 bp, Homo sapiens
tcacaagaccaagcgactcagata

SEQ ID NO: 35910 - DNA, 24 bp, Homo sapiens
tcaccaagacctgaggcacagaca

SEQ ID NO: 35911 - DNA, 24 bp, Homo sapiens
tctttcttgaagtcgccgagacca

SEQ ID NO: 35912 - DNA, 24 bp, Homo sapiens
ccgaaggaacaaactctggacaca

SEQ ID NO: 35913 - DNA, 24 bp, Homo sapiens
aaatcaagcgagtgtacgaaccca

SEQ ID NO: 35914 - DNA, 24 bp, Homo sapiens
aacggtggcagggacaggatggaa

SEQ ID NO: 35915 - DNA, 24 bp, Homo sapiens
gacgagttcaggctgcggcggctg

SEQ ID NO: 35916 - DNA, 24 bp, Homo sapiens
gccattcactgcctcggtttcccc

SEQ ID NO: 35917 - DNA, 24 bp, Homo sapiens
ccgagccccgagtgcccagcccgt

SEQ ID NO: 35918 - DNA, 24 bp, Homo sapiens
cccgagccccgagtgcccagcccg

SEQ ID NO: 35919 - DNA, 24 bp, Homo sapiens
ccccgagccccgagtgcccagccc

SEQ ID NO: 35920 - DNA, 24 bp, Homo sapiens
ccagcagctctgtcttggcattgc

SEQ ID NO: 35921 - DNA, 24 bp, Homo sapiens
tgtgacctttgaagagaaatgccg

SEQ ID NO: 35922 - DNA, 24 bp, Homo sapiens
aggtactcactctgtctcccaggc

SEQ ID NO: 35923 - DNA, 24 bp, Homo sapiens
tcccttttcactgcttttccgcct

SEQ ID NO: 35924 - DNA, 24 bp, Homo sapiens
gggacggtgcttggcgggaggctg

SEQ ID NO: 35925 - DNA, 24 bp, Homo sapiens
ccctcccacggctcctcccacagg

SEQ ID NO: 35926 - DNA, 24 bp, Homo sapiens
aagaacaaatgctgaagacctaac

SEQ ID NO: 35927 - DNA, 24 bp, Homo sapiens
aaagaacaaatgctgaagacctaa

SEQ ID NO: 35928 - DNA, 24 bp, Homo sapiens
taaagaacaaatgctgaagaccta

SEQ ID NO: 35929 - DNA, 24 bp, Homo sapiens
aaagaatgggagaagctaccagag

SEQ ID NO: 35930 - DNA, 24 bp, Homo sapiens
gaaagaatgggagaagctaccaga

SEQ ID NO: 35931 - DNA, 24 bp, Homo sapiens
ggaaagaatgggagaagctaccag

SEQ ID NO: 35932 - DNA, 25 bp, Homo sapiens
acggtgtttctccttggtcatgctg

SEQ ID NO: 35933 - DNA, 23 bp, Homo sapiens
ctggagtgcaatggtggcgatct

SEQ ID NO: 35934 - DNA, 25 bp, Homo sapiens
agcctgtttcatcccttccacttgt

SEQ ID NO: 35935 - DNA, 24 bp, Homo sapiens
ttcatcttcagcttgtggctatag

SEQ ID NO: 35936 - DNA, 24 bp, Homo sapiens
gttcatcttcagcttgtggctata

SEQ ID NO: 35937 - DNA, 24 bp, Homo sapiens
agttcatcttcagcttgtggctat

SEQ ID NO: 35938 - DNA, 24 bp, Homo sapiens
agtagagacggagtttcaccatcc

SEQ ID NO: 35939 - DNA, 24 bp, Homo sapiens
gccagggaggtcttgaactcctga

SEQ ID NO: 35940 - DNA, 24 bp, Homo sapiens
gtgatccgcctatggctggctttt

SEQ ID NO: 35941 - DNA, 24 bp, Homo sapiens
ggaccaagaagaggaagaagacca

SEQ ID NO: 35942 - DNA, 24 bp, Homo sapiens
agtaccttggcttggctcttgacg

SEQ ID NO: 35943 - DNA, 24 bp, Homo sapiens
gttgacataggcagacatcggtgg

SEQ ID NO: 35944 - DNA, 24 bp, Homo sapiens
ccagcgagaaggcagagatgaaca

SEQ ID NO: 35945 - DNA, 24 bp, Homo sapiens
tcaacgagaaattacatccccagc

SEQ ID NO: 35946 - DNA, 24 bp, Homo sapiens
tccctggccccacctcttctgcca

SEQ ID NO: 35947 - DNA, 24 bp, Homo sapiens
agggagaagttacgggaagggaga

SEQ ID NO: 35948 - DNA, 24 bp, Homo sapiens
ctcattgaatcagcatctccaggc

SEQ ID NO: 35949 - DNA, 24 bp, Homo sapiens
aagttgaggtggctgagaaagtgc

SEQ ID NO: 35950 - DNA, 24 bp, Homo sapiens
ggaccaagaagaggaagaagacca

SEQ ID NO: 35951 - DNA, 24 bp, Homo sapiens
agtaccttggcttggctcttgacg

SEQ ID NO: 35952 - DNA, 24 bp, Homo sapiens
gcgtgttggcttggctgttgacat

SEQ ID NO: 35953 - DNA, 24 bp, Homo sapiens
ctggatctcagatattactacaat

SEQ ID NO: 35954 - DNA, 24 bp, Homo sapiens
actggatctcagatattactacaa

SEQ ID NO: 35955 - DNA, 24 bp, Homo sapiens
aactggatctcagatattactaca

SEQ ID NO: 35956 - DNA, 24 bp, Homo sapiens
gctgacaggcgaggacacggatct

SEQ ID NO: 35957 - DNA, 24 bp, Homo sapiens
gtgacctcagtgattccagcaagt

SEQ ID NO: 35958 - DNA, 24 bp, Homo sapiens
ctgtctttcgggctgtggtctgtg

SEQ ID NO: 35959 - DNA, 25 bp, Homo sapiens
caggaggacattgccagaccaagtg

SEQ ID NO: 35960 - DNA, 23 bp, Homo sapiens
aggcaggcagatcaccaggtcaa

SEQ ID NO: 35961 - DNA, 23 bp, Homo sapiens
cccagaaggaggacgactttgct

SEQ ID NO: 35962 - DNA, 23 bp, Homo sapiens
ccttcgccaagcatcgcctggtg

SEQ ID NO: 35963 - DNA, 23 bp, Homo sapiens
ccgcccgccgaggcagcctccgg

SEQ ID NO: 35964 - DNA, 24 bp, Homo sapiens
gcgtgagccactgcatccagccat

SEQ ID NO: 35965 - DNA, 24 bp, Homo sapiens
ggcgtgagccactgcatccagcca

SEQ ID NO: 35966 - DNA, 24 bp, Homo sapiens
aggcgtgagccactgcatccagcc

SEQ ID NO: 35967 - DNA, 24 bp, Homo sapiens
cccgtcttggaagagaggagcatc

SEQ ID NO: 35968 - DNA, 24 bp, Homo sapiens
ccatcttggatgtgaggagcacct

SEQ ID NO: 35969 - DNA, 24 bp, Homo sapiens
ccccgtctgggaggtgaggagcac

SEQ ID NO: 35970 - DNA, 24 bp, Homo sapiens
acgaggatgctacagcggatggat

SEQ ID NO: 35971 - DNA, 24 bp, Homo sapiens
gccgagcagacctacttccagccg

SEQ ID NO: 35972 - DNA, 24 bp, Homo sapiens
gcagcggaagttcaatgtggagaa

SEQ ID NO: 35973 - DNA, 24 bp, Homo sapiens
atttattctagtaccagtttggaa

SEQ ID NO: 35974 - DNA, 24 bp, Homo sapiens
aatttattctagtaccagtttgga

SEQ ID NO: 35975 - DNA, 24 bp, Homo sapiens
taatttattctagtaccagtttgg

SEQ ID NO: 35976 - DNA, 24 bp, Homo sapiens
agaggactacggagaggtgacagc

SEQ ID NO: 35977 - DNA, 24 bp, Homo sapiens
ccagactacgccaagtacgccacg

SEQ ID NO: 35978 - DNA, 24 bp, Homo sapiens
gaggctgcggcgaagacaggcttg

SEQ ID NO: 35979 - DNA, 23 bp, Homo sapiens
ttcctgccgttgggtttgtggtc

SEQ ID NO: 35980 - DNA, 25 bp, Homo sapiens
tgaatacaggttggagtgcagtggt

SEQ ID NO: 35981 - DNA, 24 bp, Homo sapiens
caatggctcgatctcggctcagtg

SEQ ID NO: 35982 - DNA, 23 bp, Homo sapiens
agagcttcaggctggactggctt

SEQ ID NO: 35983 - DNA, 24 bp, Homo sapiens
gtgggactggaaacctcggattct

SEQ ID NO: 35984 - DNA, 24 bp, Homo sapiens
tggaaacgcagtagaaaatggctg

SEQ ID NO: 35985 - DNA, 24 bp, Homo sapiens
caatggctcgatctcggctcagtg

SEQ ID NO: 35986 - DNA, 23 bp, Homo sapiens
ctcgctgcttcctgaggtgctcc

SEQ ID NO: 35987 - DNA, 23 bp, Homo sapiens
gtgccgttcaatcccaggtcgtt

SEQ ID NO: 35988 - DNA, 25 bp, Homo sapiens
agtctgtctgggaggagaaggaagg

SEQ ID NO: 35989 - DNA, 25 bp, Homo sapiens
agcctgggtgaaagagcaagatgtc

SEQ ID NO: 35990 - DNA, 25 bp, Homo sapiens
tcagaaggctacagaaggaaatacc

SEQ ID NO: 35991 - DNA, 25 bp, Homo sapiens
tgaggcaggagaattgcttgaacct

SEQ ID NO: 35992 - DNA, 25 bp, Homo sapiens
tgagttcactggtattaaggtggtt

SEQ ID NO: 35993 - DNA, 24 bp, Homo sapiens
aaaactacaaaattagccagacat

SEQ ID NO: 35994 - DNA, 24 bp, Homo sapiens
gaaccgaggagatcactactgtgc

SEQ ID NO: 35995 - DNA, 24 bp, Homo sapiens
ctggtgcgtgaactgctttgcctg

SEQ ID NO: 35996 - DNA, 24 bp, Homo sapiens
agaaggtgatgtggtctctgctct

SEQ ID NO: 35997 - DNA, 25 bp, Homo sapiens
agcaggagagcaggaacctaaccat

SEQ ID NO: 35998 - DNA, 25 bp, Homo sapiens
tggatgtagccgactcattattgcg

SEQ ID NO: 35999 - DNA, 25 bp, Homo sapiens
tccaattccaggtgatacagccgtc

SEQ ID NO: 36000 - DNA, 24 bp, Homo sapiens
gcagcaggagagcaggaacctaac

SEQ ID NO: 36001 - DNA, 24 bp, Homo sapiens
aagacaacgccattattgacgaga

SEQ ID NO: 36002 - DNA, 24 bp, Homo sapiens
aggtgtatgcttgcttctctccca

SEQ ID NO: 36003 - DNA, 24 bp, Homo sapiens
aggtgtatgcttgcttctctccca

SEQ ID NO: 36004 - DNA, 24 bp, Homo sapiens
tggagttcaactttgaccgtgggc

SEQ ID NO: 36005 - DNA, 24 bp, Homo sapiens
gtcacttgcccaaagtcacacagc

SEQ ID NO: 36006 - DNA, 24 bp, Homo sapiens
cagcagcatcaacatcacctggaa

SEQ ID NO: 36007 - DNA, 24 bp, Homo sapiens
cagtctgtctttaaggagccctca

SEQ ID NO: 36008 - DNA, 24 bp, Homo sapiens
agaaatgaagattctcaggctctt

SEQ ID NO: 36009 - DNA, 24 bp, Homo sapiens
cagcagcatcaacatcacctggaa

SEQ ID NO: 36010 - DNA, 24 bp, Homo sapiens
cctcaagccaggaacagtaattgc

SEQ ID NO: 36011 - DNA, 24 bp, Homo sapiens
ccatgacttccaactcgcagcatc

SEQ ID NO: 36012 - DNA, 24 bp, Homo sapiens
cagcagcatcaacatcacctggaa

SEQ ID NO: 36013 - DNA, 24 bp, Homo sapiens
cctactgaatcagacattgggtgc

SEQ ID NO: 36014 - DNA, 24 bp, Homo sapiens
agaaatgaagattctcaggctctt

SEQ ID NO: 36015 - DNA, 24 bp, Homo sapiens
cctcaagccaggaacagtaattgc

SEQ ID NO: 36016 - DNA, 24 bp, Homo sapiens
cagcagcatcaacatcacctggaa

SEQ ID NO: 36017 - DNA, 24 bp, Homo sapiens
aaagtgattctgaaggtgtggtcc

SEQ ID NO: 36018 - DNA, 24 bp, Homo sapiens
ttacttgagagatggagtctcact

SEQ ID NO: 36019 - DNA, 24 bp, Homo sapiens
attacttgagagatggagtctcac

SEQ ID NO: 36020 - DNA, 24 bp, Homo sapiens
aattacttgagagatggagtctca

SEQ ID NO: 36021 - DNA, 24 bp, Homo sapiens
ctcactctgtcgctcaggctggag

SEQ ID NO: 36022 - DNA, 24 bp, Homo sapiens
tctctgcctcctcctcttggatgc

SEQ ID NO: 36023 - DNA, 24 bp, Homo sapiens
ctaagtgtgtgggcaagtgtgtca

SEQ ID NO: 36024 - DNA, 24 bp, Homo sapiens
ggtagaaaaagcacttacataatc

SEQ ID NO: 36025 - DNA, 24 bp, Homo sapiens
gggtagaaaaagcacttacataat

SEQ ID NO: 36026 - DNA, 24 bp, Homo sapiens
tgggtagaaaaagcacttacataa

SEQ ID NO: 36027 - DNA, 24 bp, Homo sapiens
acaatttaatcatgtggcttagga

SEQ ID NO: 36028 - DNA, 24 bp, Homo sapiens
cacaatttaatcatgtggcttagg

SEQ ID NO: 36029 - DNA, 24 bp, Homo sapiens
tcacaatttaatcatgtggcttag

SEQ ID NO: 36030 - DNA, 24 bp, Homo sapiens
gagaaaaagccctatgcaaatatt

SEQ ID NO: 36031 - DNA, 24 bp, Homo sapiens
agagaaaaagccctatgcaaatat

SEQ ID NO: 36032 - DNA, 24 bp, Homo sapiens
gagagaaaaagccctatgcaaata

SEQ ID NO: 36033 - DNA, 24 bp, Homo sapiens
ataaatctctggtgactttttgaa

SEQ ID NO: 36034 - DNA, 24 bp, Homo sapiens
aataaatctctggtgactttttga

SEQ ID NO: 36035 - DNA, 24 bp, Homo sapiens
gaataaatctctggtgactttttg

SEQ ID NO: 36036 - DNA, 24 bp, Homo sapiens
cagcaccagcaccaccagcccatc

SEQ ID NO: 36037 - DNA, 24 bp, Homo sapiens
cacaaccatgagctttgagggcgg

SEQ ID NO: 36038 - DNA, 24 bp, Homo sapiens
cagcagccgcagcagcagcagtgg

SEQ ID NO: 36039 - DNA, 24 bp, Homo sapiens
gctgctgccatgtaagaagtgcct

SEQ ID NO: 36040 - DNA, 24 bp, Homo sapiens
acaggtgaaacagtcgcaaatgga

SEQ ID NO: 36041 - DNA, 24 bp, Homo sapiens
gactttgcccagatccatcagagg

SEQ ID NO: 36042 - DNA, 24 bp, Homo sapiens
tctatttacaggaattagagaaag

SEQ ID NO: 36043 - DNA, 24 bp, Homo sapiens
ttctatttacaggaattagagaaa

SEQ ID NO: 36044 - DNA, 24 bp, Homo sapiens
tttctatttacaggaattagagaa

SEQ ID NO: 36045 - DNA, 24 bp, Homo sapiens
gcggcagcggcggcggcggacgag

SEQ ID NO: 36046 - DNA, 24 bp, Homo sapiens
cccggggtctcggaggagctcacg

SEQ ID NO: 36047 - DNA, 24 bp, Homo sapiens
ccctggctcggccgcgggagagag

SEQ ID NO: 36048 - DNA, 24 bp, Homo sapiens
cgttctgtcacccatgctggagtg

SEQ ID NO: 36049 - DNA, 24 bp, Homo sapiens
tcgttctgtcacccatgctggagt

SEQ ID NO: 36050 - DNA, 24 bp, Homo sapiens
ctcgttctgtcacccatgctggag

SEQ ID NO: 36051 - DNA, 24 bp, Homo sapiens
ggttcttggtctcgctgacttcaa

SEQ ID NO: 36052 - DNA, 24 bp, Homo sapiens
gcccagcatgaagaatagttcctt

SEQ ID NO: 36053 - DNA, 24 bp, Homo sapiens
acctgtatgtcctgaatgtattcc

SEQ ID NO: 36054 - DNA, 24 bp, Homo sapiens
ggttcttggtctcgctgacttcaa

SEQ ID NO: 36055 - DNA, 24 bp, Homo sapiens
tctggacccactgagagacttgct

SEQ ID NO: 36056 - DNA, 24 bp, Homo sapiens
cgcctcagttagagcctcggaatg

SEQ ID NO: 36057 - DNA, 24 bp, Homo sapiens
ccactcacggattttcactcggcg

SEQ ID NO: 36058 - DNA, 24 bp, Homo sapiens
gtccccactggagaccccgacatc

SEQ ID NO: 36059 - DNA, 24 bp, Homo sapiens
ccctgccacctgcccagcctcccg

SEQ ID NO: 36060 - DNA, 24 bp, Homo sapiens
aaattagtacctcccagtcagaaa

SEQ ID NO: 36061 - DNA, 25 bp, Homo sapiens
acctaatgcagattagagaatttgc

SEQ ID NO: 36062 - DNA, 25 bp, Homo sapiens
aaagaaatattttgttatatgggct

SEQ ID NO: 36063 - DNA, 24 bp, Homo sapiens
tatcattttagggaaaactagaaa

SEQ ID NO: 36064 - DNA, 24 bp, Homo sapiens
ttatcattttagggaaaactagaa

SEQ ID NO: 36065 - DNA, 24 bp, Homo sapiens
tttatcattttagggaaaactaga

SEQ ID NO: 36066 - DNA, 24 bp, Homo sapiens
ttgtccatctccaatgtactggca

SEQ ID NO: 36067 - DNA, 24 bp, Homo sapiens
aattgtctactgtgagccaagcaa

SEQ ID NO: 36068 - DNA, 24 bp, Homo sapiens
gcatctgtccatccgtccatccac

SEQ ID NO: 36069 - DNA, 24 bp, Homo sapiens
ggactgtctggttcctccatccat

SEQ ID NO: 36070 - DNA, 24 bp, Homo sapiens
gctgctctcctgtttcctcttcct

SEQ ID NO: 36071 - DNA, 24 bp, Homo sapiens
ttgtccatctccaatgtactggca

SEQ ID NO: 36072 - DNA, 23 bp, Homo sapiens
tcggctccttaccagctcacctc

SEQ ID NO: 36073 - DNA, 23 bp, Homo sapiens
cctgaggatggcggcgacggcgg

SEQ ID NO: 36074 - DNA, 23 bp, Homo sapiens
ccggtgggcgggagccccggcgg

SEQ ID NO: 36075 - DNA, 24 bp, Homo sapiens
ttttttttgagatggagtttcgct

SEQ ID NO: 36076 - DNA, 24 bp, Homo sapiens
tttttttttgagatggagtttcgc

SEQ ID NO: 36077 - DNA, 24 bp, Homo sapiens
tttttttttgagatggagtttcgc

SEQ ID NO: 36078 - DNA, 24 bp, Homo sapiens
ccatactccagcctgggtgacaga

SEQ ID NO: 36079 - DNA, 24 bp, Homo sapiens
accatactccagcctgggtgacag

SEQ ID NO: 36080 - DNA, 24 bp, Homo sapiens
caccatactccagcctgggtgaca

SEQ ID NO: 36081 - DNA, 24 bp, Homo sapiens
ctgaagtgcagtgccacaacctcg

SEQ ID NO: 36082 - DNA, 24 bp, Homo sapiens
tgcaacctctgcctcccaggttca

SEQ ID NO: 36083 - DNA, 24 bp, Homo sapiens
tggtggtggtgaaattagactcct

SEQ ID NO: 36084 - DNA, 24 bp, Homo sapiens
agcaggaaccatgtttactcttta

SEQ ID NO: 36085 - DNA, 24 bp, Homo sapiens
aatatttgctgaacaagtgaacaa

SEQ ID NO: 36086 - DNA, 25 bp, Homo sapiens
cggacaagtatctcctggctatggt

SEQ ID NO: 36087 - DNA, 24 bp, Homo sapiens
atgacatggaggaggacgacgagg

SEQ ID NO: 36088 - DNA, 25 bp, Homo sapiens
cgtaagcgtcggttccagttatgcc

SEQ ID NO: 36089 - DNA, 25 bp, Homo sapiens
gccaggaagaactgctctcagatag

SEQ ID NO: 36090 - DNA, 24 bp, Homo sapiens
atgacatggaggaggacgacgagg

SEQ ID NO: 36091 - DNA, 25 bp, Homo sapiens
cctcctggcaataccaacgcattca

SEQ ID NO: 36092 - DNA, 24 bp, Homo sapiens
gccaatggtacaggtcacacagca

SEQ ID NO: 36093 - DNA, 24 bp, Homo sapiens
ctgggtctgctgctgtctgtcttc

SEQ ID NO: 36094 - DNA, 24 bp, Homo sapiens
gacaccatgacgagagcttgccac

SEQ ID NO: 36095 - DNA, 23 bp, Homo sapiens
tcggtggaaggcggacaggatgc

SEQ ID NO: 36096 - DNA, 24 bp, Homo sapiens
gctgatggatagtgagacggacat

SEQ ID NO: 36097 - DNA, 23 bp, Homo sapiens
ctctcggaagtggaggcggtggg

SEQ ID NO: 36098 - DNA, 24 bp, Homo sapiens
tctctaatttgttggagctatggc

SEQ ID NO: 36099 - DNA, 24 bp, Homo sapiens
atctctaatttgttggagctatgg

SEQ ID NO: 36100 - DNA, 24 bp, Homo sapiens
aatctctaatttgttggagctatg

SEQ ID NO: 36101 - DNA, 25 bp, Homo sapiens
tggtgggttcttggtctcactgact

SEQ ID NO: 36102 - DNA, 25 bp, Homo sapiens
acaataaacctcccagtgccaagtg

SEQ ID NO: 36103 - DNA, 24 bp, Homo sapiens
gctgatggatagtgagacggacat

SEQ ID NO: 36104 - DNA, 24 bp, Homo sapiens
aatctctacaggtacagaaacacc

SEQ ID NO: 36105 - DNA, 24 bp, Homo sapiens
caatctctacaggtacagaaacac

SEQ ID NO: 36106 - DNA, 24 bp, Homo sapiens
caatctctacaggtacagaaacac

SEQ ID NO: 36107 - DNA, 24 bp, Homo sapiens
ggattctatacgtgggatggttta

SEQ ID NO: 36108 - DNA, 24 bp, Homo sapiens
tggattctatacgtgggatggttt

SEQ ID NO: 36109 - DNA, 24 bp, Homo sapiens
tggattctatacgtgggatggttt

SEQ ID NO: 36110 - DNA, 24 bp, Homo sapiens
aactgcccagacttcaccacgatg

SEQ ID NO: 36111 - DNA, 24 bp, Homo sapiens
atggaagacagaacagtggtagcc

SEQ ID NO: 36112 - DNA, 24 bp, Homo sapiens
aagaaagggatgtggctgtggctg

SEQ ID NO: 36113 - DNA, 24 bp, Homo sapiens
aaatgggtcgtaaagcagcagaga

SEQ ID NO: 36114 - DNA, 24 bp, Homo sapiens
acagtggagtggtggttcaagaag

SEQ ID NO: 36115 - DNA, 24 bp, Homo sapiens
acgagaggcttgaagacgaagagt

SEQ ID NO: 36116 - DNA, 25 bp, Homo sapiens
tggaatcagtggctcatgcctgtaa

SEQ ID NO: 36117 - DNA, 25 bp, Homo sapiens
tcatatttaatttggaggatattga

SEQ ID NO: 36118 - DNA, 25 bp, Homo sapiens
ataactactgttttaaaattattgc

SEQ ID NO: 36119 - DNA, 24 bp, Homo sapiens
gagcacgtctaggtcttccaggaa

SEQ ID NO: 36120 - DNA, 25 bp, Homo sapiens
tgcccagagtcaaaggacattccag

SEQ ID NO: 36121 - DNA, 25 bp, Homo sapiens
tctcagcaaactaacacaggaacag

SEQ ID NO: 36122 - DNA, 24 bp, Homo sapiens
aagatgctgctcccattgtctccc

SEQ ID NO: 36123 - DNA, 24 bp, Homo sapiens
ccaatgaccacctcagtctcctcc

SEQ ID NO: 36124 - DNA, 24 bp, Homo sapiens
cctgctctccacctcctccgaaag

SEQ ID NO: 36125 - DNA, 24 bp, Homo sapiens
tagaaattcaagtatgtatggaat

SEQ ID NO: 36126 - DNA, 24 bp, Homo sapiens
gtagaaattcaagtatgtatggaa

SEQ ID NO: 36127 - DNA, 24 bp, Homo sapiens
agtagaaattcaagtatgtatgga

SEQ ID NO: 36128 - DNA, 25 bp, Homo sapiens
cagagaaggtggctgtagatcctga

SEQ ID NO: 36129 - DNA, 25 bp, Homo sapiens
gaatgtgacagtccttcgtatcaga

SEQ ID NO: 36130 - DNA, 24 bp, Homo sapiens
ggaaacaaggagcaggagacagcc

SEQ ID NO: 36131 - DNA, 23 bp, Homo sapiens
gctggtcttgaactcctggcctc

SEQ ID NO: 36132 - DNA, 25 bp, Homo sapiens
gagaccaaatggacaagctggcttt

SEQ ID NO: 36133 - DNA, 25 bp, Homo sapiens
acgactgaattactagcatcattga

SEQ ID NO: 36134 - DNA, 24 bp, Homo sapiens
aaagctttgaaataattcatagtg

SEQ ID NO: 36135 - DNA, 24 bp, Homo sapiens
caaagctttgaaataattcatagt

SEQ ID NO: 36136 - DNA, 24 bp, Homo sapiens
gcaaagctttgaaataattcatag

SEQ ID NO: 36137 - DNA, 24 bp, Homo sapiens
tcaacaagaccgtgtggaacctca

SEQ ID NO: 36138 - DNA, 24 bp, Homo sapiens
gaggagtcggcagagcaggcacag

SEQ ID NO: 36139 - DNA, 24 bp, Homo sapiens
gagaagacactcgtggaggcgtcg

SEQ ID NO: 36140 - DNA, 24 bp, Homo sapiens
gaggagtcggcagagcaggcacag

SEQ ID NO: 36141 - DNA, 24 bp, Homo sapiens
tcaacaagaccgtgtggaacctca

SEQ ID NO: 36142 - DNA, 24 bp, Homo sapiens
agaacctggtggactcctacatgg

SEQ ID NO: 36143 - DNA, 24 bp, Homo sapiens
tatgaggaaagggatgcctggaga

SEQ ID NO: 36144 - DNA, 24 bp, Homo sapiens
ttatgaggaaagggatgcctggag

SEQ ID NO: 36145 - DNA, 24 bp, Homo sapiens
tttatgaggaaagggatgcctgga

SEQ ID NO: 36146 - DNA, 24 bp, Homo sapiens
tgtgcttgcagccatggtgcccag

SEQ ID NO: 36147 - DNA, 24 bp, Homo sapiens
ctgtgcttgcagccatggtgccca

SEQ ID NO: 36148 - DNA, 24 bp, Homo sapiens
ctgtgcttgcagccatggtgccca

SEQ ID NO: 36149 - DNA, 24 bp, Homo sapiens
aaaaatttaaagtggaagctattt

SEQ ID NO: 36150 - DNA, 24 bp, Homo sapiens
caaaaatttaaagtggaagctatt

SEQ ID NO: 36151 - DNA, 24 bp, Homo sapiens
caaaaatttaaagtggaagctatt

SEQ ID NO: 36152 - DNA, 24 bp, Homo sapiens
gaggaagcaggagtcagccaccaa

SEQ ID NO: 36153 - DNA, 24 bp, Homo sapiens
cagcattcagccagtcggtcacct

SEQ ID NO: 36154 - DNA, 24 bp, Homo sapiens
ttaacgccagggaccatgctctgc

SEQ ID NO: 36155 - DNA, 24 bp, Homo sapiens
attacattaagactcagctttgca

SEQ ID NO: 36156 - DNA, 24 bp, Homo sapiens
tattacattaagactcagctttgc

SEQ ID NO: 36157 - DNA, 24 bp, Homo sapiens
ttattacattaagactcagctttg

SEQ ID NO: 36158 - DNA, 24 bp, Homo sapiens
gcagtcgccgggtaagcggcacct

SEQ ID NO: 36159 - DNA, 24 bp, Homo sapiens
agcagtcgccgggtaagcggcacc

SEQ ID NO: 36160 - DNA, 24 bp, Homo sapiens
gagcagtcgccgggtaagcggcac

SEQ ID NO: 36161 - DNA, 24 bp, Homo sapiens
catgtgatatgtgtgcttggtgac

SEQ ID NO: 36162 - DNA, 24 bp, Homo sapiens
ccatgtgatatgtgtgcttggtga

SEQ ID NO: 36163 - DNA, 24 bp, Homo sapiens
accatgtgatatgtgtgcttggtg

SEQ ID NO: 36164 - DNA, 24 bp, Homo sapiens
gcttataacagcaaaaaaatgtca

SEQ ID NO: 36165 - DNA, 24 bp, Homo sapiens
tgcttataacagcaaaaaaatgtc

SEQ ID NO: 36166 - DNA, 24 bp, Homo sapiens
ctgcttataacagcaaaaaaatgt

SEQ ID NO: 36167 - DNA, 24 bp, Homo sapiens
tttcaatgaaggtaagtaataatg

SEQ ID NO: 36168 - DNA, 24 bp, Homo sapiens
atttcaatgaaggtaagtaataat

SEQ ID NO: 36169 - DNA, 24 bp, Homo sapiens
catttcaatgaaggtaagtaataa

SEQ ID NO: 36170 - DNA, 24 bp, Homo sapiens
aaagcattaaggcacaaacaaaag

SEQ ID NO: 36171 - DNA, 24 bp, Homo sapiens
gaaagcattaaggcacaaacaaaa

SEQ ID NO: 36172 - DNA, 24 bp, Homo sapiens
tgaaagcattaaggcacaaacaaa

SEQ ID NO: 36173 - DNA, 24 bp, Homo sapiens
agccctcacatctttgccctttcg

SEQ ID NO: 36174 - DNA, 24 bp, Homo sapiens
gagccctcacatctttgccctttc

SEQ ID NO: 36175 - DNA, 24 bp, Homo sapiens
tgagccctcacatctttgcccttt

SEQ ID NO: 36176 - DNA, 24 bp, Homo sapiens
ggcggtggtggcagcagtgttgaa

SEQ ID NO: 36177 - DNA, 24 bp, Homo sapiens
acattgagttcaagcccgaatctc

SEQ ID NO: 36178 - DNA, 24 bp, Homo sapiens
ctttatggatcatgaagctgagtc

SEQ ID NO: 36179 - DNA, 24 bp, Homo sapiens
ggcagttctcggtgaggaggaaga

SEQ ID NO: 36180 - DNA, 24 bp, Homo sapiens
caccgctgagctgccgagaggaag

SEQ ID NO: 36181 - DNA, 24 bp, Homo sapiens
ctgcccggctgccctcttgtagtc

SEQ ID NO: 36182 - DNA, 24 bp, Homo sapiens
tttaccaacagcaaattgacttct

SEQ ID NO: 36183 - DNA, 24 bp, Homo sapiens
atttaccaacagcaaattgacttc

SEQ ID NO: 36184 - DNA, 24 bp, Homo sapiens
aatttaccaacagcaaattgactt

SEQ ID NO: 36185 - DNA, 24 bp, Homo sapiens
atagaggagagattgaatttagtg

SEQ ID NO: 36186 - DNA, 24 bp, Homo sapiens
aatagaggagagattgaatttagt

SEQ ID NO: 36187 - DNA, 24 bp, Homo sapiens
gaatagaggagagattgaatttag

SEQ ID NO: 36188 - DNA, 24 bp, Homo sapiens
aaaacatgaaggtaacaagtgatt

SEQ ID NO: 36189 - DNA, 24 bp, Homo sapiens
aaaaacatgaaggtaacaagtgat

SEQ ID NO: 36190 - DNA, 24 bp, Homo sapiens
gaaaaacatgaaggtaacaagtga

SEQ ID NO: 36191 - DNA, 24 bp, Homo sapiens
ttaatcaaaaggtatgtaactgct

SEQ ID NO: 36192 - DNA, 24 bp, Homo sapiens
attaatcaaaaggtatgtaactgc

SEQ ID NO: 36193 - DNA, 24 bp, Homo sapiens
aattaatcaaaaggtatgtaactg

SEQ ID NO: 36194 - DNA, 24 bp, Homo sapiens
cttaaattaagtgttctacccaag

SEQ ID NO: 36195 - DNA, 24 bp, Homo sapiens
ccttaaattaagtgttctacccaa

SEQ ID NO: 36196 - DNA, 24 bp, Homo sapiens
tccttaaattaagtgttctaccca

SEQ ID NO: 36197 - DNA, 24 bp, Homo sapiens
gacaaattttggtaagaaactttg

SEQ ID NO: 36198 - DNA, 24 bp, Homo sapiens
agacaaattttggtaagaaacttt

SEQ ID NO: 36199 - DNA, 24 bp, Homo sapiens
gagacaaattttggtaagaaactt

SEQ ID NO: 36200 - DNA, 24 bp, Homo sapiens
tgggattacaggtgtgagccaccg

SEQ ID NO: 36201 - DNA, 24 bp, Homo sapiens
ctgggattacaggtgtgagccacc

SEQ ID NO: 36202 - DNA, 24 bp, Homo sapiens
gctgggattacaggtgtgagccac

SEQ ID NO: 36203 - DNA, 24 bp, Homo sapiens
tgagccttgttcagctacaactgc

SEQ ID NO: 36204 - DNA, 24 bp, Homo sapiens
gacccacatgcccccacatctttg

SEQ ID NO: 36205 - DNA, 24 bp, Homo sapiens
ccgctgtgctccgacactggctgg

SEQ ID NO: 36206 - DNA, 24 bp, Homo sapiens
agttagtaaaggtaagtataactt

SEQ ID NO: 36207 - DNA, 24 bp, Homo sapiens
gagttagtaaaggtaagtataact

SEQ ID NO: 36208 - DNA, 24 bp, Homo sapiens
agagttagtaaaggtaagtataac

SEQ ID NO: 36209 - DNA, 23 bp, Homo sapiens
ggcaacagcagcagcagcggctc

SEQ ID NO: 36210 - DNA, 23 bp, Homo sapiens
ggtagcacgagtgcgggcagcag

SEQ ID NO: 36211 - DNA, 24 bp, Homo sapiens
aattgtagaagttaagaaaaagaa

SEQ ID NO: 36212 - DNA, 24 bp, Homo sapiens
taattgtagaagttaagaaaaaga

SEQ ID NO: 36213 - DNA, 24 bp, Homo sapiens
gtaattgtagaagttaagaaaaag

SEQ ID NO: 36214 - DNA, 24 bp, Homo sapiens
agttttattagaaggacccagtgg

SEQ ID NO: 36215 - DNA, 24 bp, Homo sapiens
aagttttattagaaggacccagtg

SEQ ID NO: 36216 - DNA, 24 bp, Homo sapiens
aaagttttattagaaggacccagt

SEQ ID NO: 36217 - DNA, 24 bp, Homo sapiens
ccagcccggcctcgcctccccgga

SEQ ID NO: 36218 - DNA, 24 bp, Homo sapiens
cccgcggctcccgatggagactga

SEQ ID NO: 36219 - DNA, 24 bp, Homo sapiens
ccgccgccgccgccgctccgctgc

SEQ ID NO: 36220 - DNA, 24 bp, Homo sapiens
ccgacctgccaatcctctgttcac

SEQ ID NO: 36221 - DNA, 23 bp, Homo sapiens
tcgggtgggagaatgtgctgcta

SEQ ID NO: 36222 - DNA, 23 bp, Homo sapiens
agtcagcctcgaacgccacagaa

SEQ ID NO: 36223 - DNA, 24 bp, Homo sapiens
tgttttattagatcctaaaaacag

SEQ ID NO: 36224 - DNA, 24 bp, Homo sapiens
ttgttttattagatcctaaaaaca

SEQ ID NO: 36225 - DNA, 24 bp, Homo sapiens
tttgttttattagatcctaaaaac

SEQ ID NO: 36226 - DNA, 24 bp, Homo sapiens
ggttatagaacagccgccttcagc

SEQ ID NO: 36227 - DNA, 24 bp, Homo sapiens
gcagaaccttcccacctttcagca

SEQ ID NO: 36228 - DNA, 23 bp, Homo sapiens
cactcctgggctcaagcaatcct

SEQ ID NO: 36229 - DNA, 24 bp, Homo sapiens
ccttccactacaacgtgagcagcc

SEQ ID NO: 36230 - DNA, 24 bp, Homo sapiens
cttggcaggaggatgtggcagatg

SEQ ID NO: 36231 - DNA, 24 bp, Homo sapiens
cacagagctacagcacctgctaca

SEQ ID NO: 36232 - DNA, 24 bp, Homo sapiens
acaaaggcaaggatcggagcccaa

SEQ ID NO: 36233 - DNA, 24 bp, Homo sapiens
tacaaaggcaaggatcggagccca

SEQ ID NO: 36234 - DNA, 24 bp, Homo sapiens
atacaaaggcaaggatcggagccc

SEQ ID NO: 36235 - DNA, 24 bp, Homo sapiens
attcacaggagactgcgtgttggc

SEQ ID NO: 36236 - DNA, 25 bp, Homo sapiens
ggagaaggagtgtctgcttgaaggc

SEQ ID NO: 36237 - DNA, 25 bp, Homo sapiens
gcctcagacagcagccactttatcc

SEQ ID NO: 36238 - DNA, 24 bp, Homo sapiens
tcttcctaaaggtgaggcatctat

SEQ ID NO: 36239 - DNA, 24 bp, Homo sapiens
ttcttcctaaaggtgaggcatcta

SEQ ID NO: 36240 - DNA, 24 bp, Homo sapiens
cttcttcctaaaggtgaggcatct

SEQ ID NO: 36241 - DNA, 24 bp, Homo sapiens
gctgtaagaaggtaaaacttaact

SEQ ID NO: 36242 - DNA, 24 bp, Homo sapiens
tgctgtaagaaggtaaaacttaac

SEQ ID NO: 36243 - DNA, 24 bp, Homo sapiens
atgctgtaagaaggtaaaacttaa

SEQ ID NO: 36244 - DNA, 24 bp, Homo sapiens
taacaaaaaagattatgtatatga

SEQ ID NO: 36245 - DNA, 24 bp, Homo sapiens
gtaacaaaaaagattatgtatatg

SEQ ID NO: 36246 - DNA, 24 bp, Homo sapiens
agtaacaaaaaagattatgtatat

SEQ ID NO: 36247 - DNA, 24 bp, Homo sapiens
aacatatcaaggcaagtatatttt

SEQ ID NO: 36248 - DNA, 24 bp, Homo sapiens
gaacatatcaaggcaagtatattt

SEQ ID NO: 36249 - DNA, 24 bp, Homo sapiens
agaacatatcaaggcaagtatatt

SEQ ID NO: 36250 - DNA, 24 bp, Homo sapiens
tatcttaatagacaaagaagttat

SEQ ID NO: 36251 - DNA, 24 bp, Homo sapiens
ttatcttaatagacaaagaagtta

SEQ ID NO: 36252 - DNA, 24 bp, Homo sapiens
tttatcttaatagacaaagaagtt

SEQ ID NO: 36253 - DNA, 24 bp, Homo sapiens
atcattctcaggtaattcattcag

SEQ ID NO: 36254 - DNA, 24 bp, Homo sapiens
gatcattctcaggtaattcattca

SEQ ID NO: 36255 - DNA, 24 bp, Homo sapiens
agatcattctcaggtaattcattc

SEQ ID NO: 36256 - DNA, 24 bp, Homo sapiens
ttctacctcaggttataaagtcag

SEQ ID NO: 36257 - DNA, 24 bp, Homo sapiens
tttctacctcaggttataaagtca

SEQ ID NO: 36258 - DNA, 24 bp, Homo sapiens
gtttctacctcaggttataaagtc

SEQ ID NO: 36259 - DNA, 24 bp, Homo sapiens
ttctacctcaggttagcaaaatat

SEQ ID NO: 36260 - DNA, 24 bp, Homo sapiens
tttctacctcaggttagcaaaata

SEQ ID NO: 36261 - DNA, 24 bp, Homo sapiens
gtttctacctcaggttagcaaaat

SEQ ID NO: 36262 - DNA, 24 bp, Homo sapiens
ggcctatctttatttcagggacga

SEQ ID NO: 36263 - DNA, 24 bp, Homo sapiens
cggcctatctttatttcagggacg

SEQ ID NO: 36264 - DNA, 24 bp, Homo sapiens
ccggcctatctttatttcagggac

SEQ ID NO: 36265 - DNA, 23 bp, Homo sapiens
gctggtgctggtctgtgttctgg

SEQ ID NO: 36266 - DNA, 23 bp, Homo sapiens
ggccattgtctatctcattgcct

SEQ ID NO: 36267 - DNA, 24 bp, Homo sapiens
ccagcaccgactactaccaagagc

SEQ ID NO: 36268 - DNA, 23 bp, Homo sapiens
ataaacaagggggttttctgggc

SEQ ID NO: 36269 - DNA, 24 bp, Homo sapiens
gagacatttctgaaatgtttttgc

SEQ ID NO: 36270 - DNA, 24 bp, Homo sapiens
cggctacccagagaagttcagtgc

SEQ ID NO: 36271 - DNA, 24 bp, Homo sapiens
agttgttacgggttctggtcatgc

SEQ ID NO: 36272 - DNA, 23 bp, Homo sapiens
tcttcctgctgctgctcctcaca

SEQ ID NO: 36273 - DNA, 24 bp, Homo sapiens
caacccacaccgcccctgccagcc

SEQ ID NO: 36274 - DNA, 24 bp, Homo sapiens
gcctggccctgtctttggcagggg

SEQ ID NO: 36275 - DNA, 24 bp, Homo sapiens
ggctgccactagcccgcctggcgg

SEQ ID NO: 36276 - DNA, 24 bp, Homo sapiens
accacaacgattcctacgctctcc

SEQ ID NO: 36277 - DNA, 24 bp, Homo sapiens
ggtgctgctggctgacaagaagaa

SEQ ID NO: 36278 - DNA, 24 bp, Homo sapiens
ggtggtcttcaagtccgatggcag

SEQ ID NO: 36279 - DNA, 23 bp, Homo sapiens
gagacgcacagccacatcaccac

SEQ ID NO: 36280 - DNA, 25 bp, Homo sapiens
acctcccagaccatcatttccacca

SEQ ID NO: 36281 - DNA, 23 bp, Homo sapiens
ctggagttcgtcaggaggaccgt

SEQ ID NO: 36282 - DNA, 23 bp, Homo sapiens
ggtgaacacagcctgctagtcca

SEQ ID NO: 36283 - DNA, 23 bp, Homo sapiens
ggtcaatgcccacgcctatcctg

SEQ ID NO: 36284 - DNA, 25 bp, Homo sapiens
gcaacacctaccaagccatcctctc

SEQ ID NO: 36285 - DNA, 25 bp, Homo sapiens
caagtcgctggagccattcactctg

SEQ ID NO: 36286 - DNA, 23 bp, Homo sapiens
ccaggactgtggtctgccattgc

SEQ ID NO: 36287 - DNA, 23 bp, Homo sapiens
gaggtggctggctgcaagtgtga

SEQ ID NO: 36288 - DNA, 24 bp, Homo sapiens
accagcccggccaccacacccaca

SEQ ID NO: 36289 - DNA, 24 bp, Homo sapiens
gaccagcccggccaccacacccac

SEQ ID NO: 36290 - DNA, 24 bp, Homo sapiens
tgaccagcccggccaccacaccca

SEQ ID NO: 36291 - DNA, 24 bp, Homo sapiens
accagcccggccaccacacccatg

SEQ ID NO: 36292 - DNA, 24 bp, Homo sapiens
gaccagcccggccaccacacccat

SEQ ID NO: 36293 - DNA, 24 bp, Homo sapiens
tgaccagcccggccaccacaccca

SEQ ID NO: 36294 - DNA, 24 bp, Homo sapiens
gactgtctccagcgggacggaacc

SEQ ID NO: 36295 - DNA, 24 bp, Homo sapiens
ctggtccccgacagcagaaaggat

SEQ ID NO: 36296 - DNA, 24 bp, Homo sapiens
cccatgcccaccacagccgctctg

SEQ ID NO: 36297 - DNA, 24 bp, Homo sapiens
ctgtgaggagggtactcagcagag

SEQ ID NO: 36298 - DNA, 24 bp, Homo sapiens
cctgtgaggagggtactcagcaga

SEQ ID NO: 36299 - DNA, 24 bp, Homo sapiens
tcctgtgaggagggtactcagcag

SEQ ID NO: 36300 - DNA, 24 bp, Homo sapiens
ctgtgagtgtctgtgcgatgccgt

SEQ ID NO: 36301 - DNA, 24 bp, Homo sapiens
caagggtgtgtgcgtggactggag

SEQ ID NO: 36302 - DNA, 24 bp, Homo sapiens
cttctacaacacgcacacgcagga

SEQ ID NO: 36303 - DNA, 24 bp, Homo sapiens
gcggtggctgctgctgtcctgctg

SEQ ID NO: 36304 - DNA, 24 bp, Homo sapiens
gagctcctctccactgtgcaccat

SEQ ID NO: 36305 - DNA, 24 bp, Homo sapiens
tctcttacctcaatgccatctcct

SEQ ID NO: 36306 - DNA, 24 bp, Homo sapiens
cacgccacctgcctcgacaccttc

SEQ ID NO: 36307 - DNA, 24 bp, Homo sapiens
gctgcatccgggagcgagacttcc

SEQ ID NO: 36308 - DNA, 24 bp, Homo sapiens
aagcgatcctcctgcctcagcctt

SEQ ID NO: 36309 - DNA, 24 bp, Homo sapiens
agcctggagtacagtggtgcgacc

SEQ ID NO: 36310 - DNA, 24 bp, Homo sapiens
tcactgtttcttcaacctcctggg

SEQ ID NO: 36311 - DNA, 24 bp, Homo sapiens
ccaggagccatgttgtcagaagtc

SEQ ID NO: 36312 - DNA, 24 bp, Homo sapiens
gccggggaggcggcggcggcggca

SEQ ID NO: 36313 - DNA, 24 bp, Homo sapiens
ctgctccggcttcggcgcggaggg

SEQ ID NO: 36314 - DNA, 24 bp, Homo sapiens
cacgcctctctggaccagctctgc

SEQ ID NO: 36315 - DNA, 24 bp, Homo sapiens
cagcaccatctgaatgccctcggc

SEQ ID NO: 36316 - DNA, 24 bp, Homo sapiens
gcgcaggcggtggtggctgtggca

SEQ ID NO: 36317 - DNA, 24 bp, Homo sapiens
cgcagggaccgccttggaccgcag

SEQ ID NO: 36318 - DNA, 24 bp, Homo sapiens
gcgcagggaccgccttggaccgca

SEQ ID NO: 36319 - DNA, 24 bp, Homo sapiens
tgcgcagggaccgccttggaccgc

SEQ ID NO: 36320 - DNA, 24 bp, Homo sapiens
ttttactgtagtccaaaattgaag

SEQ ID NO: 36321 - DNA, 24 bp, Homo sapiens
tttttactgtagtccaaaattgaa

SEQ ID NO: 36322 - DNA, 24 bp, Homo sapiens
ttttttactgtagtccaaaattga

SEQ ID NO: 36323 - DNA, 24 bp, Homo sapiens
tgtaatttcagagacactataatg

SEQ ID NO: 36324 - DNA, 24 bp, Homo sapiens
ttgtaatttcagagacactataat

SEQ ID NO: 36325 - DNA, 24 bp, Homo sapiens
tttgtaatttcagagacactataa

SEQ ID NO: 36326 - DNA, 24 bp, Homo sapiens
caggcaggcggcgggcagcgggag

SEQ ID NO: 36327 - DNA, 24 bp, Homo sapiens
acctcctcctcctctttctcctga

SEQ ID NO: 36328 - DNA, 24 bp, Homo sapiens
tcgccccagcggtgcggagcgccg

SEQ ID NO: 36329 - DNA, 24 bp, Homo sapiens
tgaatcctgagcaacccttcattg

SEQ ID NO: 36330 - DNA, 24 bp, Homo sapiens
ctgaatcctgagcaacccttcatt

SEQ ID NO: 36331 - DNA, 24 bp, Homo sapiens
tctgaatcctgagcaacccttcat

SEQ ID NO: 36332 - DNA, 24 bp, Homo sapiens
aatggcagtggaggtgtcagaaga

SEQ ID NO: 36333 - DNA, 24 bp, Homo sapiens
cggatgacgctgcctatgaagtag

SEQ ID NO: 36334 - DNA, 24 bp, Homo sapiens
acctccagtcctaattgtcacacc

SEQ ID NO: 36335 - DNA, 24 bp, Homo sapiens
aacgtgatggtgaaggaggtgtgg

SEQ ID NO: 36336 - DNA, 24 bp, Homo sapiens
actagctgtactgtgtccgacctt

SEQ ID NO: 36337 - DNA, 24 bp, Homo sapiens
accgagaacatctgtgggctcagt

SEQ ID NO: 36338 - DNA, 24 bp, Homo sapiens
attcaggcacttaccaggtgacgg

SEQ ID NO: 36339 - DNA, 24 bp, Homo sapiens
ctggcaggcgaggaggtgagcatc

SEQ ID NO: 36340 - DNA, 24 bp, Homo sapiens
agcctgtgaaccttctcatccctt

SEQ ID NO: 36341 - DNA, 24 bp, Homo sapiens
tgaatgagaccgtggttggactgt

SEQ ID NO: 36342 - DNA, 24 bp, Homo sapiens
ctggctggctggagaagaacaagg

SEQ ID NO: 36343 - DNA, 24 bp, Homo sapiens
ttcgctctgattcactatgctggt

SEQ ID NO: 36344 - DNA, 24 bp, Homo sapiens
tgtgaacgccaaatgtgcttccct

SEQ ID NO: 36345 - DNA, 24 bp, Homo sapiens
ggacctcatgcttgatgtggagag

SEQ ID NO: 36346 - DNA, 24 bp, Homo sapiens
gccgcctgtgccgcccttgacaaa

SEQ ID NO: 36347 - DNA, 24 bp, Homo sapiens
ccagcattgatgaccaggaagagc

SEQ ID NO: 36348 - DNA, 24 bp, Homo sapiens
cagatagtgctgtggacatcctgg

SEQ ID NO: 36349 - DNA, 24 bp, Homo sapiens
aagcaaagggaagagcaggcagag

SEQ ID NO: 36350 - DNA, 24 bp, Homo sapiens
atcgctgagtcccaggtcaacaag

SEQ ID NO: 36351 - DNA, 24 bp, Homo sapiens
gagctggatgaggcagaggagcgg

SEQ ID NO: 36352 - DNA, 24 bp, Homo sapiens
aacctgtccaagttccgcaaggtg

SEQ ID NO: 36353 - DNA, 24 bp, Homo sapiens
tgcttcctcagcccatgggcatca

SEQ ID NO: 36354 - DNA, 24 bp, Homo sapiens
ctgcttcctcagcccatgggcatc

SEQ ID NO: 36355 - DNA, 24 bp, Homo sapiens
cctgcttcctcagcccatgggcat

SEQ ID NO: 36356 - DNA, 24 bp, Homo sapiens
aggagcttcaggcacgcatcgagg

SEQ ID NO: 36357 - DNA, 24 bp, Homo sapiens
aaggagcttcaggcacgcatcgag

SEQ ID NO: 36358 - DNA, 24 bp, Homo sapiens
caaggagcttcaggcacgcatcga

SEQ ID NO: 36359 - DNA, 24 bp, Homo sapiens
cggcagaggtatcgcatcctgaac

SEQ ID NO: 36360 - DNA, 24 bp, Homo sapiens
ggctcgtcctttcagactgtgtca

SEQ ID NO: 36361 - DNA, 24 bp, Homo sapiens
tattgagaagggcaaaggcaaggc

SEQ ID NO: 36362 - DNA, 24 bp, Homo sapiens
atgaaggtcctccagcggaactgc

SEQ ID NO: 36363 - DNA, 24 bp, Homo sapiens
ctcttcaccaaggtcaagccgctg

SEQ ID NO: 36364 - DNA, 24 bp, Homo sapiens
aaggaggaggagctggtgaaggtc

SEQ ID NO: 36365 - DNA, 24 bp, Homo sapiens
gctggagttctggcacacttagag

SEQ ID NO: 36366 - DNA, 24 bp, Homo sapiens
gccaagaagcagcagcaactaagt

SEQ ID NO: 36367 - DNA, 24 bp, Homo sapiens
ccgcttctacaagtgactcgccag

SEQ ID NO: 36368 - DNA, 24 bp, Homo sapiens
cctcacatctacgccatcgcagac

SEQ ID NO: 36369 - DNA, 23 bp, Homo sapiens
acaagggcaagaagaggcacgag

SEQ ID NO: 36370 - DNA, 24 bp, Homo sapiens
ccatctactcggagaagatcgtcg

SEQ ID NO: 36371 - DNA, 24 bp, Homo sapiens
agttgtacaagaagaagccattga

SEQ ID NO: 36372 - DNA, 24 bp, Homo sapiens
aagttgtacaagaagaagccattg

SEQ ID NO: 36373 - DNA, 24 bp, Homo sapiens
gaagttgtacaagaagaagccatt

SEQ ID NO: 36374 - DNA, 25 bp, Homo sapiens
gcattgtttaggaagactggctgga

SEQ ID NO: 36375 - DNA, 25 bp, Homo sapiens
cacacccatgacaaactctccagat

SEQ ID NO: 36376 - DNA, 25 bp, Homo sapiens
ctggacggttcaagactgagcaact

SEQ ID NO: 36377 - DNA, 24 bp, Homo sapiens
aagtgctgggattacaggtgtgag

SEQ ID NO: 36378 - DNA, 24 bp, Homo sapiens
gactaccaagtgtgatatgtcaga

SEQ ID NO: 36379 - DNA, 24 bp, Homo sapiens
tttaaacctgaactcagtggtggc

SEQ ID NO: 36380 - DNA, 24 bp, Homo sapiens
tccgcccctagatccaggaaagcg

SEQ ID NO: 36381 - DNA, 24 bp, Homo sapiens
ctccgcccctagatccaggaaagc

SEQ ID NO: 36382 - DNA, 24 bp, Homo sapiens
cctccgcccctagatccaggaaag

SEQ ID NO: 36383 - DNA, 24 bp, Homo sapiens
aaaaccttaggggatagattttca

SEQ ID NO: 36384 - DNA, 24 bp, Homo sapiens
caaaaccttaggggatagattttc

SEQ ID NO: 36385 - DNA, 24 bp, Homo sapiens
ccaaaaccttaggggatagatttt

SEQ ID NO: 36386 - DNA, 24 bp, Homo sapiens
ttcgtgctgctggagaacttcacc

SEQ ID NO: 36387 - DNA, 24 bp, Homo sapiens
gcggcgatttcgggagaatctcat

SEQ ID NO: 36388 - DNA, 24 bp, Homo sapiens
ccgtcctggtctctgtcaatccct

SEQ ID NO: 36389 - DNA, 24 bp, Homo sapiens
aacgccttcttcctggaccatgtg

SEQ ID NO: 36390 - DNA, 24 bp, Homo sapiens
ggctcatccgaggcttcatcctgc

SEQ ID NO: 36391 - DNA, 24 bp, Homo sapiens
ccagtcgtggtggcgtggaacact

SEQ ID NO: 36392 - DNA, 24 bp, Homo sapiens
ttctacaaaaggtaattttatatt

SEQ ID NO: 36393 - DNA, 24 bp, Homo sapiens
tttctacaaaaggtaattttatat

SEQ ID NO: 36394 - DNA, 24 bp, Homo sapiens
ctttctacaaaaggtaattttata

SEQ ID NO: 36395 - DNA, 24 bp, Homo sapiens
aaatattccagaaaaatggctttg

SEQ ID NO: 36396 - DNA, 24 bp, Homo sapiens
gaaatattccagaaaaatggcttt

SEQ ID NO: 36397 - DNA, 24 bp, Homo sapiens
tgaaatattccagaaaaatggctt

SEQ ID NO: 36398 - DNA, 24 bp, Homo sapiens
taccaaggagcggcacagtatgaa

SEQ ID NO: 36399 - DNA, 24 bp, Homo sapiens
gtcaaccctttcaagcagatgcca

SEQ ID NO: 36400 - DNA, 24 bp, Homo sapiens
catcgtggagaatctgaagaagag

SEQ ID NO: 36401 - DNA, 24 bp, Homo sapiens
tcttggtagataaaaatggctttg

SEQ ID NO: 36402 - DNA, 24 bp, Homo sapiens
ttcttggtagataaaaatggcttt

SEQ ID NO: 36403 - DNA, 24 bp, Homo sapiens
tttcttggtagataaaaatggctt

SEQ ID NO: 36404 - DNA, 24 bp, Homo sapiens
tggagcacagtcagatggagcact

SEQ ID NO: 36405 - DNA, 24 bp, Homo sapiens
cagttgttcggctggattgtggag

SEQ ID NO: 36406 - DNA, 24 bp, Homo sapiens
cctcaagcagcactccttcatcgg

SEQ ID NO: 36407 - DNA, 24 bp, Homo sapiens
gtatcgacctcattgaagccaagc

SEQ ID NO: 36408 - DNA, 24 bp, Homo sapiens
ttggacctgttggatgaagaatgt

SEQ ID NO: 36409 - DNA, 24 bp, Homo sapiens
ctccagcagccagcacttccagaa

SEQ ID NO: 36410 - DNA, 24 bp, Homo sapiens
tattttgtaaggctttgtttaaag

SEQ ID NO: 36411 - DNA, 24 bp, Homo sapiens
ctattttgtaaggctttgtttaaa

SEQ ID NO: 36412 - DNA, 24 bp, Homo sapiens
actattttgtaaggctttgtttaa

SEQ ID NO: 36413 - DNA, 24 bp, Homo sapiens
ttagcagccagttcaagcggtcac

SEQ ID NO: 36414 - DNA, 24 bp, Homo sapiens
gctgcggtactcaggaatgatgga

SEQ ID NO: 36415 - DNA, 24 bp, Homo sapiens
cgtgtgctgctgccaggtgtgaag

SEQ ID NO: 36416 - DNA, 24 bp, Homo sapiens
ccacgatgactggcagataggcaa

SEQ ID NO: 36417 - DNA, 24 bp, Homo sapiens
cgtgtgctgctgccaggtgtgaag

SEQ ID NO: 36418 - DNA, 24 bp, Homo sapiens
gctgcggtactcaggaatgatgga

SEQ ID NO: 36419 - DNA, 24 bp, Homo sapiens
aagaggagggcagtggtggtcatt

SEQ ID NO: 36420 - DNA, 24 bp, Homo sapiens
cgcagatccatctacgacaccgtc

SEQ ID NO: 36421 - DNA, 24 bp, Homo sapiens
agatggtggagaaggtgttcggct

SEQ ID NO: 36422 - DNA, 24 bp, Homo sapiens
tctttaaacagacctcagagagct

SEQ ID NO: 36423 - DNA, 24 bp, Homo sapiens
ttctttaaacagacctcagagagc

SEQ ID NO: 36424 - DNA, 24 bp, Homo sapiens
tttctttaaacagacctcagagag

SEQ ID NO: 36425 - DNA, 24 bp, Homo sapiens
agttggcagaggctgtgacagtga

SEQ ID NO: 36426 - DNA, 24 bp, Homo sapiens
aagttggcagaggctgtgacagtg

SEQ ID NO: 36427 - DNA, 24 bp, Homo sapiens
caagttggcagaggctgtgacagt

SEQ ID NO: 36428 - DNA, 24 bp, Homo sapiens
ggaagagaagaagcgactaaggca

SEQ ID NO: 36429 - DNA, 24 bp, Homo sapiens
aagcagcagccaggaggtagcaag

SEQ ID NO: 36430 - DNA, 24 bp, Homo sapiens
gtccgagctaactgaagttcctgc

SEQ ID NO: 36431 - DNA, 24 bp, Homo sapiens
attctaaattacaaaggtaagaga

SEQ ID NO: 36432 - DNA, 24 bp, Homo sapiens
tgtgtgtgtgtgtgtaatttctgc

SEQ ID NO: 36433 - DNA, 24 bp, Homo sapiens
agtacattactaaatatataaagt

SEQ ID NO: 36434 - DNA, 24 bp, Homo sapiens
ggctcgtcattctcctggaagtcc

SEQ ID NO: 36435 - DNA, 24 bp, Homo sapiens
tcggtcacatcagcgggaaatacg

SEQ ID NO: 36436 - DNA, 24 bp, Homo sapiens
aatgaaggaccgacctgccccacc

SEQ ID NO: 36437 - DNA, 24 bp, Homo sapiens
gacagcgcggggttaaacccatcc

SEQ ID NO: 36438 - DNA, 24 bp, Homo sapiens
tgacagcgcggggttaaacccatc

SEQ ID NO: 36439 - DNA, 24 bp, Homo sapiens
gtgacagcgcggggttaaacccat

SEQ ID NO: 36440 - DNA, 24 bp, Homo sapiens
gctcactgcaacctctacctccca

SEQ ID NO: 36441 - DNA, 24 bp, Homo sapiens
ctgattctcctgcctcagcctccc

SEQ ID NO: 36442 - DNA, 24 bp, Homo sapiens
acccaggctggagtgcagtggtgg

SEQ ID NO: 36443 - DNA, 24 bp, Homo sapiens
ctttaatataggaaggggaagaag

SEQ ID NO: 36444 - DNA, 24 bp, Homo sapiens
actttaatataggaaggggaagaa

SEQ ID NO: 36445 - DNA, 24 bp, Homo sapiens
aactttaatataggaaggggaaga

SEQ ID NO: 36446 - DNA, 23 bp, Homo sapiens
ctgccgccctgagtcactgcctg

SEQ ID NO: 36447 - DNA, 23 bp, Homo sapiens
gcctcctgctcctcccgctgctg

SEQ ID NO: 36448 - DNA, 24 bp, Homo sapiens
aaatggtctcggaacctgtcgccc

SEQ ID NO: 36449 - DNA, 24 bp, Homo sapiens
gcggtctccctggtagagtttgta

SEQ ID NO: 36450 - DNA, 24 bp, Homo sapiens
ctccgccgccgccactcaagcatc

SEQ ID NO: 36451 - DNA, 24 bp, Homo sapiens
ctagtgacagcagcagcagcagca

SEQ ID NO: 36452 - DNA, 24 bp, Homo sapiens
aatctgacagcagtagctctagca

SEQ ID NO: 36453 - DNA, 24 bp, Homo sapiens
gaagaggagatggctagctcgact

SEQ ID NO: 36454 - DNA, 24 bp, Homo sapiens
ccctggtagagtttgtaggcttgc

SEQ ID NO: 36455 - DNA, 24 bp, Homo sapiens
cattttctgcccatctctggtcgc

SEQ ID NO: 36456 - DNA, 24 bp, Homo sapiens
ctccgccgccgccactcaagcatc

SEQ ID NO: 36457 - DNA, 24 bp, Homo sapiens
gcggtctccctggtagagtttgta

SEQ ID NO: 36458 - DNA, 24 bp, Homo sapiens
ctccgccgccgccactcaagcatc

SEQ ID NO: 36459 - DNA, 24 bp, Homo sapiens
ccattcggctgcggtacatctcgg

SEQ ID NO: 36460 - DNA, 24 bp, Homo sapiens
tttttatgtagagaagagaattta

SEQ ID NO: 36461 - DNA, 24 bp, Homo sapiens
atttttatgtagagaagagaattt

SEQ ID NO: 36462 - DNA, 24 bp, Homo sapiens
catttttatgtagagaagagaatt

SEQ ID NO: 36463 - DNA, 24 bp, Homo sapiens
ccttcagattccgtggaagctgct

SEQ ID NO: 36464 - DNA, 24 bp, Homo sapiens
aacattcagatggcagatcacagt

SEQ ID NO: 36465 - DNA, 24 bp, Homo sapiens
ccaaagcgagcgaagctagggtcg

SEQ ID NO: 36466 - DNA, 24 bp, Homo sapiens
agggcaagcaggctccaggtggcc

SEQ ID NO: 36467 - DNA, 24 bp, Homo sapiens
aagggcaagcaggctccaggtggc

SEQ ID NO: 36468 - DNA, 24 bp, Homo sapiens
aaagggcaagcaggctccaggtgg

SEQ ID NO: 36469 - DNA, 24 bp, Homo sapiens
aaagtggagagcaaccattaatct

SEQ ID NO: 36470 - DNA, 24 bp, Homo sapiens
taaagtggagagcaaccattaatc

SEQ ID NO: 36471 - DNA, 24 bp, Homo sapiens
ataaagtggagagcaaccattaat

SEQ ID NO: 36472 - DNA, 24 bp, Homo sapiens
gctagtcttttgtaagtattgtat

SEQ ID NO: 36473 - DNA, 24 bp, Homo sapiens
agctagtcttttgtaagtattgta

SEQ ID NO: 36474 - DNA, 24 bp, Homo sapiens
cagctagtcttttgtaagtattgt

SEQ ID NO: 36475 - DNA, 24 bp, Homo sapiens
atttttaaaagaaaactatgtgca

SEQ ID NO: 36476 - DNA, 24 bp, Homo sapiens
catttttaaaagaaaactatgtgc

SEQ ID NO: 36477 - DNA, 24 bp, Homo sapiens
tcatttttaaaagaaaactatgtg

SEQ ID NO: 36478 - DNA, 24 bp, Homo sapiens
tattctaataggcaaggtcttaga

SEQ ID NO: 36479 - DNA, 24 bp, Homo sapiens
ttattctaataggcaaggtcttag

SEQ ID NO: 36480 - DNA, 24 bp, Homo sapiens
tttattctaataggcaaggtctta

SEQ ID NO: 36481 - DNA, 23 bp, Homo sapiens
cagcagcggatctcagtggtgtg

SEQ ID NO: 36482 - DNA, 25 bp, Homo sapiens
ctcaccatctataacgccaacatcg

SEQ ID NO: 36483 - DNA, 24 bp, Homo sapiens
ttacaggcgaggatggcagtgagt

SEQ ID NO: 36484 - DNA, 24 bp, Homo sapiens
tatttccgacagttagtattttgg

SEQ ID NO: 36485 - DNA, 24 bp, Homo sapiens
ctatttccgacagttagtattttg

SEQ ID NO: 36486 - DNA, 24 bp, Homo sapiens
actatttccgacagttagtatttt

SEQ ID NO: 36487 - DNA, 24 bp, Homo sapiens
tctctacgtaggtttattaattgg

SEQ ID NO: 36488 - DNA, 24 bp, Homo sapiens
ttctctacgtaggtttattaattg

SEQ ID NO: 36489 - DNA, 24 bp, Homo sapiens
cttctctacgtaggtttattaatt

SEQ ID NO: 36490 - DNA, 24 bp, Homo sapiens
aaatgtatgaggttgtcttaccat

SEQ ID NO: 36491 - DNA, 24 bp, Homo sapiens
aaaatgtatgaggttgtcttacca

SEQ ID NO: 36492 - DNA, 24 bp, Homo sapiens
aaaaatgtatgaggttgtcttacc

SEQ ID NO: 36493 - DNA, 24 bp, Homo sapiens
tacttttctaggtgttatataaca

SEQ ID NO: 36494 - DNA, 24 bp, Homo sapiens
gtacttttctaggtgttatataac

SEQ ID NO: 36495 - DNA, 24 bp, Homo sapiens
tgtacttttctaggtgttatataa

SEQ ID NO: 36496 - DNA, 24 bp, Homo sapiens
cagcaaagaaggtggtcgtttccc

SEQ ID NO: 36497 - DNA, 24 bp, Homo sapiens
cagaagaaaggcaagaaggctgct

SEQ ID NO: 36498 - DNA, 24 bp, Homo sapiens
tgatagcagtggagaagaggtcgt

SEQ ID NO: 36499 - DNA, 24 bp, Homo sapiens
caaaaaggcagcagcaacacctgc

SEQ ID NO: 36500 - DNA, 24 bp, Homo sapiens
gcaaaaaggcagcagcaacacctg

SEQ ID NO: 36501 - DNA, 24 bp, Homo sapiens
ggcaaaaaggcagcagcaacacct

SEQ ID NO: 36502 - DNA, 24 bp, Homo sapiens
cagttgccacaccagccaagaaag

SEQ ID NO: 36503 - DNA, 24 bp, Homo sapiens
cagcaaagaaggtggtcgtttccc

SEQ ID NO: 36504 - DNA, 24 bp, Homo sapiens
cagaagaaaggcaagaaggctgct

SEQ ID NO: 36505 - DNA, 24 bp, Homo sapiens
ggcagcagcaacacctgccaagaa

SEQ ID NO: 36506 - DNA, 24 bp, Homo sapiens
aggcagcagcaacacctgccaaga

SEQ ID NO: 36507 - DNA, 24 bp, Homo sapiens
aaggcagcagcaacacctgccaag

SEQ ID NO: 36508 - DNA, 24 bp, Homo sapiens
cttcggcagaggtagagcaggtct

SEQ ID NO: 36509 - DNA, 24 bp, Homo sapiens
acttcggcagaggtagagcaggtc

SEQ ID NO: 36510 - DNA, 24 bp, Homo sapiens
gacttcggcagaggtagagcaggt

SEQ ID NO: 36511 - DNA, 24 bp, Homo sapiens
catatccagaggaagcctacattg

SEQ ID NO: 36512 - DNA, 24 bp, Homo sapiens
gcatatccagaggaagcctacatt

SEQ ID NO: 36513 - DNA, 24 bp, Homo sapiens
ggcatatccagaggaagcctacat

SEQ ID NO: 36514 - DNA, 24 bp, Homo sapiens
aactgagtgacttaaattacaaag

SEQ ID NO: 36515 - DNA, 24 bp, Homo sapiens
caactgagtgacttaaattacaaa

SEQ ID NO: 36516 - DNA, 24 bp, Homo sapiens
acaactgagtgacttaaattacaa

SEQ ID NO: 36517 - DNA, 24 bp, Homo sapiens
tacagagtgatgtaagtgtcattt

SEQ ID NO: 36518 - DNA, 24 bp, Homo sapiens
atacagagtgatgtaagtgtcatt

SEQ ID NO: 36519 - DNA, 24 bp, Homo sapiens
gatacagagtgatgtaagtgtcat

SEQ ID NO: 36520 - DNA, 24 bp, Homo sapiens
ttcaaagtgatgtacgtgaaaacc

SEQ ID NO: 36521 - DNA, 24 bp, Homo sapiens
attcaaagtgatgtacgtgaaaac

SEQ ID NO: 36522 - DNA, 24 bp, Homo sapiens
gattcaaagtgatgtacgtgaaaa

SEQ ID NO: 36523 - DNA, 24 bp, Homo sapiens
atgccagtgaggtaaaatataaag

SEQ ID NO: 36524 - DNA, 24 bp, Homo sapiens
aatgccagtgaggtaaaatataaa

SEQ ID NO: 36525 - DNA, 24 bp, Homo sapiens
taatgccagtgaggtaaaatataa

SEQ ID NO: 36526 - DNA, 24 bp, Homo sapiens
actccagaacacctgcgtactaca

SEQ ID NO: 36527 - DNA, 24 bp, Homo sapiens
tcaaaggacaaatttacctcaatt

SEQ ID NO: 36528 - DNA, 24 bp, Homo sapiens
gtagattgaagtttgtaggtgcca

SEQ ID NO: 36529 - DNA, 24 bp, Homo sapiens
ggtagattgaagtttgtaggtgcc

SEQ ID NO: 36530 - DNA, 24 bp, Homo sapiens
tggtagattgaagtttgtaggtgc

SEQ ID NO: 36531 - DNA, 24 bp, Homo sapiens
agtgtaaagatctgaattacaaag

SEQ ID NO: 36532 - DNA, 24 bp, Homo sapiens
cagtgtaaagatctgaattacaaa

SEQ ID NO: 36533 - DNA, 24 bp, Homo sapiens
ccagtgtaaagatctgaattacaa

SEQ ID NO: 36534 - DNA, 24 bp, Homo sapiens
ttcagagtgatttgaactacaagg

SEQ ID NO: 36535 - DNA, 24 bp, Homo sapiens
attcagagtgatttgaactacaag

SEQ ID NO: 36536 - DNA, 24 bp, Homo sapiens
aattcagagtgatttgaactacaa

SEQ ID NO: 36537 - DNA, 24 bp, Homo sapiens
ttatgaacgaaaaactctacaaac

SEQ ID NO: 36538 - DNA, 24 bp, Homo sapiens
attatgaacgaaaaactctacaaa

SEQ ID NO: 36539 - DNA, 24 bp, Homo sapiens
aattatgaacgaaaaactctacaa

SEQ ID NO: 36540 - DNA, 24 bp, Homo sapiens
agaccaagattcatgtgatgcctg

SEQ ID NO: 36541 - DNA, 24 bp, Homo sapiens
acaagccaagcagaatcaaacact

SEQ ID NO: 36542 - DNA, 24 bp, Homo sapiens
aggctatgatctcccagttgatgc

SEQ ID NO: 36543 - DNA, 24 bp, Homo sapiens
atctgagtgagtatctgtatgttg

SEQ ID NO: 36544 - DNA, 24 bp, Homo sapiens
catctgagtgagtatctgtatgtt

SEQ ID NO: 36545 - DNA, 24 bp, Homo sapiens
acatctgagtgagtatctgtatgt

SEQ ID NO: 36546 - DNA, 24 bp, Homo sapiens
ttatcttccagaaactttgatttt

SEQ ID NO: 36547 - DNA, 24 bp, Homo sapiens
tttatcttccagaaactttgattt

SEQ ID NO: 36548 - DNA, 24 bp, Homo sapiens
ttttatcttccagaaactttgatt

SEQ ID NO: 36549 - DNA, 24 bp, Homo sapiens
acactaatgtagtaagtatacaag

SEQ ID NO: 36550 - DNA, 24 bp, Homo sapiens
aacactaatgtagtaagtatacaa

SEQ ID NO: 36551 - DNA, 24 bp, Homo sapiens
aaacactaatgtagtaagtataca

SEQ ID NO: 36552 - DNA, 24 bp, Homo sapiens
tttctttctagtttttagaagtac

SEQ ID NO: 36553 - DNA, 24 bp, Homo sapiens
ctttctttctagtttttagaagta

SEQ ID NO: 36554 - DNA, 24 bp, Homo sapiens
cctttctttctagtttttagaagt

SEQ ID NO: 36555 - DNA, 24 bp, Homo sapiens
tttaaatacagaaggcataaatat

SEQ ID NO: 36556 - DNA, 24 bp, Homo sapiens
ttttaaatacagaaggcataaata

SEQ ID NO: 36557 - DNA, 24 bp, Homo sapiens
tttttaaatacagaaggcataaat

SEQ ID NO: 36558 - DNA, 24 bp, Homo sapiens
taagtttacagactacgaacatat

SEQ ID NO: 36559 - DNA, 24 bp, Homo sapiens
ataagtttacagactacgaacata

SEQ ID NO: 36560 - DNA, 24 bp, Homo sapiens
aataagtttacagactacgaacat

SEQ ID NO: 36561 - DNA, 24 bp, Homo sapiens
tggaccgctcggtaagggttcaca

SEQ ID NO: 36562 - DNA, 24 bp, Homo sapiens
atggaccgctcggtaagggttcac

SEQ ID NO: 36563 - DNA, 24 bp, Homo sapiens
catggaccgctcggtaagggttca

SEQ ID NO: 36564 - DNA, 24 bp, Homo sapiens
ggttgaagcgattctcctgcctca

SEQ ID NO: 36565 - DNA, 24 bp, Homo sapiens
gatctcagcttaccgcaacctccg

SEQ ID NO: 36566 - DNA, 24 bp, Homo sapiens
gcatgaaaccaaggacaagacact

SEQ ID NO: 36567 - DNA, 24 bp, Homo sapiens
cctgattacaccgagtactgtgca

SEQ ID NO: 36568 - DNA, 24 bp, Homo sapiens
tgattgatatgaagtgactttcag

SEQ ID NO: 36569 - DNA, 24 bp, Homo sapiens
tgacttttcatcaatggcctaaaa

SEQ ID NO: 36570 - DNA, 24 bp, Homo sapiens
cctgcccgcctgcgccgccccttt

SEQ ID NO: 36571 - DNA, 24 bp, Homo sapiens
gtccggagttggcggggccctgcg

SEQ ID NO: 36572 - DNA, 24 bp, Homo sapiens
accaggcccgcgggctcagctctc

SEQ ID NO: 36573 - DNA, 24 bp, Homo sapiens
tccaactcctgctttgtgtgaccc

SEQ ID NO: 36574 - DNA, 24 bp, Homo sapiens
gcatcacagccaccgcagcatctt

SEQ ID NO: 36575 - DNA, 24 bp, Homo sapiens
cgttgacacttaccatgctgctgc

SEQ ID NO: 36576 - DNA, 24 bp, Homo sapiens
cggcacacaggagccagccccagt

SEQ ID NO: 36577 - DNA, 24 bp, Homo sapiens
gcggcacacaggagccagccccag

SEQ ID NO: 36578 - DNA, 24 bp, Homo sapiens
ggcggcacacaggagccagcccca

SEQ ID NO: 36579 - DNA, 24 bp, Homo sapiens
ctagtgagaatgtaagtctttgtg

SEQ ID NO: 36580 - DNA, 24 bp, Homo sapiens
actagtgagaatgtaagtctttgt

SEQ ID NO: 36581 - DNA, 24 bp, Homo sapiens
aactagtgagaatgtaagtctttg

SEQ ID NO: 36582 - DNA, 24 bp, Homo sapiens
cataaatcacaatataaaaagaac

SEQ ID NO: 36583 - DNA, 24 bp, Homo sapiens
acataaatcacaatataaaaagaa

SEQ ID NO: 36584 - DNA, 24 bp, Homo sapiens
tacataaatcacaatataaaaaga

SEQ ID NO: 36585 - DNA, 24 bp, Homo sapiens
tggaatctgtggatagtgaatatt

SEQ ID NO: 36586 - DNA, 24 bp, Homo sapiens
atggaatctgtggatagtgaatat

SEQ ID NO: 36587 - DNA, 24 bp, Homo sapiens
tatggaatctgtggatagtgaata

SEQ ID NO: 36588 - DNA, 24 bp, Homo sapiens
ggcctttacctatataaaaagaac

SEQ ID NO: 36589 - DNA, 24 bp, Homo sapiens
gggcctttacctatataaaaagaa

SEQ ID NO: 36590 - DNA, 24 bp, Homo sapiens
agggcctttacctatataaaaaga

SEQ ID NO: 36591 - DNA, 25 bp, Homo sapiens
ggcgaagattctcattacctgttcc

SEQ ID NO: 36592 - DNA, 23 bp, Homo sapiens
gaccgcctctctcctcctcagtg

SEQ ID NO: 36593 - DNA, 23 bp, Homo sapiens
ggaggacaggaggagaggcgaag

SEQ ID NO: 36594 - DNA, 23 bp, Homo sapiens
ttggcagcagaggtgagacgaag

SEQ ID NO: 36595 - DNA, 24 bp, Homo sapiens
gtctggaggaatggggacaccaaa

SEQ ID NO: 36596 - DNA, 25 bp, Homo sapiens
tgctgtaaaagaagaagttgtgggt

SEQ ID NO: 36597 - DNA, 24 bp, Homo sapiens
gcagcagcgaggcatgaagacccc

SEQ ID NO: 36598 - DNA, 24 bp, Homo sapiens
ggcagcagcgaggcatgaagaccc

SEQ ID NO: 36599 - DNA, 24 bp, Homo sapiens
aggcagcagcgaggcatgaagacc

SEQ ID NO: 36600 - DNA, 24 bp, Homo sapiens
aacttgcctggacagctatggtgt

SEQ ID NO: 36601 - DNA, 24 bp, Homo sapiens
gcttagtggctcagtgtggacgat

SEQ ID NO: 36602 - DNA, 24 bp, Homo sapiens
tggaagagtctgttgttctgtgga

SEQ ID NO: 36603 - DNA, 24 bp, Homo sapiens
tccctgtataggaacaaatgaatc

SEQ ID NO: 36604 - DNA, 24 bp, Homo sapiens
ttccctgtataggaacaaatgaat

SEQ ID NO: 36605 - DNA, 24 bp, Homo sapiens
tttccctgtataggaacaaatgaa

SEQ ID NO: 36606 - DNA, 24 bp, Homo sapiens
attgtcagatgttcccagtgctgc

SEQ ID NO: 36607 - DNA, 24 bp, Homo sapiens
cattgtcagatgttcccagtgctg

SEQ ID NO: 36608 - DNA, 24 bp, Homo sapiens
acattgtcagatgttcccagtgct

SEQ ID NO: 36609 - DNA, 24 bp, Homo sapiens
ccaagtacaaggtactgacacatt

SEQ ID NO: 36610 - DNA, 24 bp, Homo sapiens
accaagtacaaggtactgacacat

SEQ ID NO: 36611 - DNA, 24 bp, Homo sapiens
caccaagtacaaggtactgacaca

SEQ ID NO: 36612 - DNA, 24 bp, Homo sapiens
tactggctacaagattcgctaccg

SEQ ID NO: 36613 - DNA, 24 bp, Homo sapiens
tgtcactgagaccttggtaagcgg

SEQ ID NO: 36614 - DNA, 24 bp, Homo sapiens
agccacctgctccagccacacaaa

SEQ ID NO: 36615 - DNA, 24 bp, Homo sapiens
tttccttgcagaatccaagaaaac

SEQ ID NO: 36616 - DNA, 24 bp, Homo sapiens
ttttccttgcagaatccaagaaaa

SEQ ID NO: 36617 - DNA, 24 bp, Homo sapiens
tttttccttgcagaatccaagaaa

SEQ ID NO: 36618 - DNA, 24 bp, Homo sapiens
ttcttaataaggtaattactgtat

SEQ ID NO: 36619 - DNA, 24 bp, Homo sapiens
cttcttaataaggtaattactgta

SEQ ID NO: 36620 - DNA, 24 bp, Homo sapiens
acttcttaataaggtaattactgt

SEQ ID NO: 36621 - DNA, 24 bp, Homo sapiens
aggtggcaatggatgaccacaagc

SEQ ID NO: 36622 - DNA, 24 bp, Homo sapiens
gaggtggcaatggatgaccacaag

SEQ ID NO: 36623 - DNA, 24 bp, Homo sapiens
ggaggtggcaatggatgaccacaa

SEQ ID NO: 36624 - DNA, 24 bp, Homo sapiens
acggaagaactgcctggtgaagaa

SEQ ID NO: 36625 - DNA, 24 bp, Homo sapiens
ccaccatctgctcggacaagacgg

SEQ ID NO: 36626 - DNA, 24 bp, Homo sapiens
atgaggctgacaccaccgaagatc

SEQ ID NO: 36627 - DNA, 24 bp, Homo sapiens
ttgcctacacatggttcaacctgc

SEQ ID NO: 36628 - DNA, 24 bp, Homo sapiens
atcgaagcacttctgccccacgtc

SEQ ID NO: 36629 - DNA, 24 bp, Homo sapiens
aaaacatgaaaagcgtatgtcaaa

SEQ ID NO: 36630 - DNA, 24 bp, Homo sapiens
ggaagaactggactcagaggatgc

SEQ ID NO: 36631 - DNA, 24 bp, Homo sapiens
ctgcgaggatgaggagctggaatt

SEQ ID NO: 36632 - DNA, 24 bp, Homo sapiens
ggtgaagatacagcagcctcctga

SEQ ID NO: 36633 - DNA, 24 bp, Homo sapiens
gaaccccatcttcagcctccccag

SEQ ID NO: 36634 - DNA, 24 bp, Homo sapiens
ggggaagaggggtctgagccacct

SEQ ID NO: 36635 - DNA, 24 bp, Homo sapiens
ccctggtccctttgactatgtggg

SEQ ID NO: 36636 - DNA, 24 bp, Homo sapiens
ttggcgacaggatattgatctggg

SEQ ID NO: 36637 - DNA, 24 bp, Homo sapiens
actatagtcaccgccagaaggagc

SEQ ID NO: 36638 - DNA, 24 bp, Homo sapiens
aggacacctgggcaggcgagggcg

SEQ ID NO: 36639 - DNA, 24 bp, Homo sapiens
gtgggcatcatctctgagggcaac

SEQ ID NO: 36640 - DNA, 24 bp, Homo sapiens
cccatcacggccaaggccattgcc

SEQ ID NO: 36641 - DNA, 24 bp, Homo sapiens
acatcgccgcccggctcaacattc

SEQ ID NO: 36642 - DNA, 24 bp, Homo sapiens
tccgactactatgaagaagcctga

SEQ ID NO: 36643 - DNA, 24 bp, Homo sapiens
tgttcagctctgcatctccacagg

SEQ ID NO: 36644 - DNA, 24 bp, Homo sapiens
cccagcaccaccatcccggaatac

SEQ ID NO: 36645 - DNA, 24 bp, Homo sapiens
tttgtaaaatggatgaatttcacc

SEQ ID NO: 36646 - DNA, 24 bp, Homo sapiens
ctttgtaaaatggatgaatttcac

SEQ ID NO: 36647 - DNA, 24 bp, Homo sapiens
tctttgtaaaatggatgaatttca

SEQ ID NO: 36648 - DNA, 24 bp, Homo sapiens
cagggatcaaggttattatggtta

SEQ ID NO: 36649 - DNA, 24 bp, Homo sapiens
gcagggatcaaggttattatggtt

SEQ ID NO: 36650 - DNA, 24 bp, Homo sapiens
tgcagggatcaaggttattatggt

SEQ ID NO: 36651 - DNA, 24 bp, Homo sapiens
ttcatagacaaataaagaagaagt

SEQ ID NO: 36652 - DNA, 24 bp, Homo sapiens
gttcatagacaaataaagaagaag

SEQ ID NO: 36653 - DNA, 24 bp, Homo sapiens
tgttcatagacaaataaagaagaa

SEQ ID NO: 36654 - DNA, 24 bp, Homo sapiens
gaggtggctgagctgctgcttgaa

SEQ ID NO: 36655 - DNA, 24 bp, Homo sapiens
tagaaattgtccgcttcctgctgg

SEQ ID NO: 36656 - DNA, 24 bp, Homo sapiens
tggaggaggacgaggagcttcagg

SEQ ID NO: 36657 - DNA, 24 bp, Homo sapiens
agaacagactggaaaaacatttac

SEQ ID NO: 36658 - DNA, 24 bp, Homo sapiens
aagaacagactggaaaaacattta

SEQ ID NO: 36659 - DNA, 24 bp, Homo sapiens
gaagaacagactggaaaaacattt

SEQ ID NO: 36660 - DNA, 24 bp, Homo sapiens
ctgccatgcaggtctgagtacagt

SEQ ID NO: 36661 - DNA, 24 bp, Homo sapiens
tctgccatgcaggtctgagtacag

SEQ ID NO: 36662 - DNA, 24 bp, Homo sapiens
ctctgccatgcaggtctgagtaca

SEQ ID NO: 36663 - DNA, 24 bp, Homo sapiens
aatttggccaattttcagctataa

SEQ ID NO: 36664 - DNA, 24 bp, Homo sapiens
aaatttggccaattttcagctata

SEQ ID NO: 36665 - DNA, 24 bp, Homo sapiens
aaaatttggccaattttcagctat

SEQ ID NO: 36666 - DNA, 24 bp, Homo sapiens
atattttaaagatgaaaactttat

SEQ ID NO: 36667 - DNA, 24 bp, Homo sapiens
gatattttaaagatgaaaacttta

SEQ ID NO: 36668 - DNA, 24 bp, Homo sapiens
ggatattttaaagatgaaaacttt

SEQ ID NO: 36669 - DNA, 23 bp, Homo sapiens
gtccagcaggagcagatccagga

SEQ ID NO: 36670 - DNA, 24 bp, Homo sapiens
tcggagcagaggatggtacagcag

SEQ ID NO: 36671 - DNA, 25 bp, Homo sapiens
tgatagccagtccaggagtccaagt

SEQ ID NO: 36672 - DNA, 24 bp, Homo sapiens
aaaaactgcatgtaagtattgaga

SEQ ID NO: 36673 - DNA, 24 bp, Homo sapiens
aaaaaactgcatgtaagtattgag

SEQ ID NO: 36674 - DNA, 24 bp, Homo sapiens
gaaaaaactgcatgtaagtattga

SEQ ID NO: 36675 - DNA, 24 bp, Homo sapiens
gaggaagggcttcaagttggtggc

SEQ ID NO: 36676 - DNA, 24 bp, Homo sapiens
aacgcaccttcctggccgtgaagc

SEQ ID NO: 36677 - DNA, 24 bp, Homo sapiens
cggctggtgggcgagattgtgcgg

SEQ ID NO: 36678 - DNA, 24 bp, Homo sapiens
ctcaccgtagccttgaactcctgg

SEQ ID NO: 36679 - DNA, 24 bp, Homo sapiens
agactactgacttggaccagcagg

SEQ ID NO: 36680 - DNA, 24 bp, Homo sapiens
gcaatcctcccacctaagcctctg

SEQ ID NO: 36681 - DNA, 24 bp, Homo sapiens
tttctttacagctaaaagaactgt

SEQ ID NO: 36682 - DNA, 24 bp, Homo sapiens
atttctttacagctaaaagaactg

SEQ ID NO: 36683 - DNA, 24 bp, Homo sapiens
tatttctttacagctaaaagaact

SEQ ID NO: 36684 - DNA, 24 bp, Homo sapiens
atctatgacacagagaagaagatg

SEQ ID NO: 36685 - DNA, 24 bp, Homo sapiens
tatctatgacacagagaagaagat

SEQ ID NO: 36686 - DNA, 24 bp, Homo sapiens
atatctatgacacagagaagaaga

SEQ ID NO: 36687 - DNA, 24 bp, Homo sapiens
ggaggagaagttgagacaggcggt

SEQ ID NO: 36688 - DNA, 24 bp, Homo sapiens
gtgtgatgtgactcagagccagcc

SEQ ID NO: 36689 - DNA, 24 bp, Homo sapiens
cactgtgtctggatgccgcctgcc

SEQ ID NO: 36690 - DNA, 24 bp, Homo sapiens
cttgcctgcagtaagtgacgaaaa

SEQ ID NO: 36691 - DNA, 24 bp, Homo sapiens
tcttgcctgcagtaagtgacgaaa

SEQ ID NO: 36692 - DNA, 24 bp, Homo sapiens
ttcttgcctgcagtaagtgacgaa

SEQ ID NO: 36693 - DNA, 24 bp, Homo sapiens
tgagatggagaagcagcagcagga

SEQ ID NO: 36694 - DNA, 24 bp, Homo sapiens
gaccgcaacatcaaggaggctcgt

SEQ ID NO: 36695 - DNA, 24 bp, Homo sapiens
cgccaagaagaacttcggaggatg

SEQ ID NO: 36696 - DNA, 24 bp, Homo sapiens
cagccgccaccaccgccaatacct

SEQ ID NO: 36697 - DNA, 24 bp, Homo sapiens
atcaacatcaccaccagcagcagc

SEQ ID NO: 36698 - DNA, 24 bp, Homo sapiens
gctcttttctcgggacgggagagg

SEQ ID NO: 36699 - DNA, 24 bp, Homo sapiens
tccgattcaacagcgtctcctcct

SEQ ID NO: 36700 - DNA, 24 bp, Homo sapiens
gcccgacctcagagacaactttga

SEQ ID NO: 36701 - DNA, 24 bp, Homo sapiens
gtgggcaggaagaggctttcagga

SEQ ID NO: 36702 - DNA, 24 bp, Homo sapiens
tcggtcaactatcttcgtgcgtct

SEQ ID NO: 36703 - DNA, 24 bp, Homo sapiens
tggtgaaagtggaactgctggagg

SEQ ID NO: 36704 - DNA, 24 bp, Homo sapiens
catcaccacgccaccaacgcctct

SEQ ID NO: 36705 - DNA, 24 bp, Homo sapiens
agttgctgccaggtctgatccacg

SEQ ID NO: 36706 - DNA, 24 bp, Homo sapiens
gttccaggctacaatccgctcagt

SEQ ID NO: 36707 - DNA, 24 bp, Homo sapiens
gcaaagcagcaagtccacgagggc

SEQ ID NO: 36708 - DNA, 24 bp, Homo sapiens
tcattacatagttggaatggtaac

SEQ ID NO: 36709 - DNA, 24 bp, Homo sapiens
ttcattacatagttggaatggtaa

SEQ ID NO: 36710 - DNA, 24 bp, Homo sapiens
tttcattacatagttggaatggta

SEQ ID NO: 36711 - DNA, 24 bp, Homo sapiens
aaaaaaaaaaagacttcccttttc

SEQ ID NO: 36712 - DNA, 24 bp, Homo sapiens
aaaaaaaaaaaagacttccctttt

SEQ ID NO: 36713 - DNA, 24 bp, Homo sapiens
aaaaaaaaaaaaagacttcccttt

SEQ ID NO: 36714 - DNA, 24 bp, Homo sapiens
tatggattaccagggcaccaggca

SEQ ID NO: 36715 - DNA, 24 bp, Homo sapiens
cctcacctgccatccaccttcaac

SEQ ID NO: 36716 - DNA, 24 bp, Homo sapiens
accaatacctatgagaggggaaca

SEQ ID NO: 36717 - DNA, 24 bp, Homo sapiens
caaggaccacttcagcgacgggca

SEQ ID NO: 36718 - DNA, 24 bp, Homo sapiens
acgctggtggtggtggtgctgatg

SEQ ID NO: 36719 - DNA, 24 bp, Homo sapiens
cgcaacagctccttccacttcctg

SEQ ID NO: 36720 - DNA, 24 bp, Homo sapiens
cgcaacagctccttccacttcctg

SEQ ID NO: 36721 - DNA, 24 bp, Homo sapiens
acgctggtggtggtggtgctgatg

SEQ ID NO: 36722 - DNA, 24 bp, Homo sapiens
gtactgcaaggaccacttcagcga

SEQ ID NO: 36723 - DNA, 24 bp, Homo sapiens
tgagggcttcaaagtgtctgaggc

SEQ ID NO: 36724 - DNA, 24 bp, Homo sapiens
agctgcacttcatgtacgtggcgg

SEQ ID NO: 36725 - DNA, 24 bp, Homo sapiens
gaagaagcggcgggagcccctcgg

SEQ ID NO: 36726 - DNA, 24 bp, Homo sapiens
gggcaagactggcctcctgtgtca

SEQ ID NO: 36727 - DNA, 24 bp, Homo sapiens
tgggcaagactggcctcctgtgtc

SEQ ID NO: 36728 - DNA, 24 bp, Homo sapiens
atgggcaagactggcctcctgtgt

SEQ ID NO: 36729 - DNA, 24 bp, Homo sapiens
gtgctggtgctcacagtgctgctg

SEQ ID NO: 36730 - DNA, 24 bp, Homo sapiens
gtgcggctgggatgggctggattg

SEQ ID NO: 36731 - DNA, 24 bp, Homo sapiens
gtcttcccttaccaccggcctagt

SEQ ID NO: 36732 - DNA, 24 bp, Homo sapiens
caacagataagaaaggaaaaaagt

SEQ ID NO: 36733 - DNA, 24 bp, Homo sapiens
ccaacagataagaaaggaaaaaag

SEQ ID NO: 36734 - DNA, 24 bp, Homo sapiens
gccaacagataagaaaggaaaaaa

SEQ ID NO: 36735 - DNA, 24 bp, Homo sapiens
tgcatttttaagcattagatggct

SEQ ID NO: 36736 - DNA, 24 bp, Homo sapiens
atgcatttttaagcattagatggc

SEQ ID NO: 36737 - DNA, 24 bp, Homo sapiens
aatgcatttttaagcattagatgg

SEQ ID NO: 36738 - DNA, 24 bp, Homo sapiens
atttttcttaggtaattatgcttt

SEQ ID NO: 36739 - DNA, 24 bp, Homo sapiens
catttttcttaggtaattatgctt

SEQ ID NO: 36740 - DNA, 24 bp, Homo sapiens
gcatttttcttaggtaattatgct

SEQ ID NO: 36741 - DNA, 24 bp, Homo sapiens
gttaagcaaagagataaacactgt

SEQ ID NO: 36742 - DNA, 24 bp, Homo sapiens
agttaagcaaagagataaacactg

SEQ ID NO: 36743 - DNA, 24 bp, Homo sapiens
aagttaagcaaagagataaacact

SEQ ID NO: 36744 - DNA, 24 bp, Homo sapiens
tgttgtcagatttgccccccaggt

SEQ ID NO: 36745 - DNA, 24 bp, Homo sapiens
ttgttgtcagatttgccccccagg

SEQ ID NO: 36746 - DNA, 24 bp, Homo sapiens
cttgttgtcagatttgccccccag

SEQ ID NO: 36747 - DNA, 25 bp, Homo sapiens
ccgtgtcacagatccagaagatgaa

SEQ ID NO: 36748 - DNA, 25 bp, Homo sapiens
ccgatagtgacacatcttcaggcag

SEQ ID NO: 36749 - DNA, 23 bp, Homo sapiens
tgtccccttccctttccttcccc

SEQ ID NO: 36750 - DNA, 24 bp, Homo sapiens
tttggctaaaggaaagaaatgctg

SEQ ID NO: 36751 - DNA, 24 bp, Homo sapiens
atttggctaaaggaaagaaatgct

SEQ ID NO: 36752 - DNA, 24 bp, Homo sapiens
gatttggctaaaggaaagaaatgc

SEQ ID NO: 36753 - DNA, 24 bp, Homo sapiens
atgtgtacaaggtggagacaattg

SEQ ID NO: 36754 - DNA, 24 bp, Homo sapiens
gatgtgtacaaggtggagacaatt

SEQ ID NO: 36755 - DNA, 24 bp, Homo sapiens
tgatgtgtacaaggtggagacaat

SEQ ID NO: 36756 - DNA, 24 bp, Homo sapiens
gctggagcgaggtgtgtgcctggc

SEQ ID NO: 36757 - DNA, 24 bp, Homo sapiens
agctggagcgaggtgtgtgcctgg

SEQ ID NO: 36758 - DNA, 24 bp, Homo sapiens
gagctggagcgaggtgtgtgcctg

SEQ ID NO: 36759 - DNA, 25 bp, Homo sapiens
atatctctgcctgtcatcctgctgg

SEQ ID NO: 36760 - DNA, 23 bp, Homo sapiens
acttcctcatcctgctcgtgccg

SEQ ID NO: 36761 - DNA, 23 bp, Homo sapiens
ccctggctgctggtggctgtggc

SEQ ID NO: 36762 - DNA, 24 bp, Homo sapiens
gtatcagccaattaacagcacaca

SEQ ID NO: 36763 - DNA, 24 bp, Homo sapiens
agtatcagccaattaacagcacac

SEQ ID NO: 36764 - DNA, 24 bp, Homo sapiens
aagtatcagccaattaacagcaca

SEQ ID NO: 36765 - DNA, 24 bp, Homo sapiens
cgtggaagcccttgaatggtttcg

SEQ ID NO: 36766 - DNA, 25 bp, Homo sapiens
tgaatggacatctgtggttgtggca

SEQ ID NO: 36767 - DNA, 24 bp, Homo sapiens
cgtgcgtgtgaatgtggtgaacag

SEQ ID NO: 36768 - DNA, 24 bp, Homo sapiens
attcagtcaaagtaagtagaaaat

SEQ ID NO: 36769 - DNA, 24 bp, Homo sapiens
tattcagtcaaagtaagtagaaaa

SEQ ID NO: 36770 - DNA, 24 bp, Homo sapiens
ttattcagtcaaagtaagtagaaa

SEQ ID NO: 36771 - DNA, 24 bp, Homo sapiens
caaaaatattggtgtttcaaaatc

SEQ ID NO: 36772 - DNA, 24 bp, Homo sapiens
tcaaaaatattggtgtttcaaaat

SEQ ID NO: 36773 - DNA, 24 bp, Homo sapiens
atcaaaaatattggtgtttcaaaa

SEQ ID NO: 36774 - DNA, 24 bp, Homo sapiens
gtgatgcaatgattaacaacaacc

SEQ ID NO: 36775 - DNA, 24 bp, Homo sapiens
tgtgatgcaatgattaacaacaac

SEQ ID NO: 36776 - DNA, 24 bp, Homo sapiens
ttgtgatgcaatgattaacaacaa

SEQ ID NO: 36777 - DNA, 25 bp, Homo sapiens
actggcatcatctttaccctcctgg

SEQ ID NO: 36778 - DNA, 23 bp, Homo sapiens
acggatgttggtgactgctgtgg

SEQ ID NO: 36779 - DNA, 23 bp, Homo sapiens
cctgtggctgagatcgtggttgg

SEQ ID NO: 36780 - DNA, 24 bp, Homo sapiens
gccagacacatttgttcagcacat

SEQ ID NO: 36781 - DNA, 24 bp, Homo sapiens
agccagacacatttgttcagcaca

SEQ ID NO: 36782 - DNA, 24 bp, Homo sapiens
aagccagacacatttgttcagcac

SEQ ID NO: 36783 - DNA, 23 bp, Homo sapiens
cgaggtgcataccggacccccat

SEQ ID NO: 36784 - DNA, 24 bp, Homo sapiens
tttatgtttagctctttaatccat

SEQ ID NO: 36785 - DNA, 24 bp, Homo sapiens
ttttatgtttagctctttaatcca

SEQ ID NO: 36786 - DNA, 24 bp, Homo sapiens
tttttatgtttagctctttaatcc

SEQ ID NO: 36787 - DNA, 24 bp, Homo sapiens
tcagatcacagctgccttcactat

SEQ ID NO: 36788 - DNA, 24 bp, Homo sapiens
atcagatcacagctgccttcacta

SEQ ID NO: 36789 - DNA, 24 bp, Homo sapiens
aatcagatcacagctgccttcact

SEQ ID NO: 36790 - DNA, 24 bp, Homo sapiens
gctgtttgtcggggagctcttctt

SEQ ID NO: 36791 - DNA, 24 bp, Homo sapiens
tgctgtttgtcggggagctcttct

SEQ ID NO: 36792 - DNA, 24 bp, Homo sapiens
ctgctgtttgtcggggagctcttc

SEQ ID NO: 36793 - DNA, 24 bp, Homo sapiens
tcgtggtctcgctgacttcaagga

SEQ ID NO: 36794 - DNA, 24 bp, Homo sapiens
gccacttcacatcaacagcagatt

SEQ ID NO: 36795 - DNA, 24 bp, Homo sapiens
tgagtgcctatcaacaccaccacg

SEQ ID NO: 36796 - DNA, 24 bp, Homo sapiens
gggtgataaaggaaaggagaaggc

SEQ ID NO: 36797 - DNA, 24 bp, Homo sapiens
gaggcgggcagatcacctgaggtc

SEQ ID NO: 36798 - DNA, 24 bp, Homo sapiens
aaatatcagtcttggccgggcacg

SEQ ID NO: 36799 - DNA, 24 bp, Homo sapiens
ggagttagtcaaggagcctgcgag

SEQ ID NO: 36800 - DNA, 24 bp, Homo sapiens
cgcaaggcaggtgagcagcaggaa

SEQ ID NO: 36801 - DNA, 24 bp, Homo sapiens
gaggcagagcagatgggcaatgag

SEQ ID NO: 36802 - DNA, 24 bp, Homo sapiens
aagcgattctcctgcctcagcctc

SEQ ID NO: 36803 - DNA, 24 bp, Homo sapiens
agctcactgcaacctccacctctc

SEQ ID NO: 36804 - DNA, 24 bp, Homo sapiens
acccagactggagtgcaatggcgg

SEQ ID NO: 36805 - DNA, 24 bp, Homo sapiens
tgtttttaaagggtcaaattatta

SEQ ID NO: 36806 - DNA, 24 bp, Homo sapiens
ttgtttttaaagggtcaaattatt

SEQ ID NO: 36807 - DNA, 24 bp, Homo sapiens
tttgtttttaaagggtcaaattat

SEQ ID NO: 36808 - DNA, 24 bp, Homo sapiens
ctcaataaaggaagttggttttta

SEQ ID NO: 36809 - DNA, 24 bp, Homo sapiens
actcaataaaggaagttggttttt

SEQ ID NO: 36810 - DNA, 24 bp, Homo sapiens
tactcaataaaggaagttggtttt

SEQ ID NO: 36811 - DNA, 24 bp, Homo sapiens
agagtgtacaggtaaataaatata

SEQ ID NO: 36812 - DNA, 24 bp, Homo sapiens
aagagtgtacaggtaaataaatat

SEQ ID NO: 36813 - DNA, 24 bp, Homo sapiens
aaagagtgtacaggtaaataaata

SEQ ID NO: 36814 - DNA, 24 bp, Homo sapiens
ctagggaccttctgctgccccacg

SEQ ID NO: 36815 - DNA, 24 bp, Homo sapiens
gcagccacgcagctcgtgctgagc

SEQ ID NO: 36816 - DNA, 24 bp, Homo sapiens
ctccgcttggcgctgggccttctg

SEQ ID NO: 36817 - DNA, 24 bp, Homo sapiens
aagcactacaggtaaaaataacta

SEQ ID NO: 36818 - DNA, 24 bp, Homo sapiens
aaagcactacaggtaaaaataact

SEQ ID NO: 36819 - DNA, 24 bp, Homo sapiens
aaaagcactacaggtaaaaataac

SEQ ID NO: 36820 - DNA, 24 bp, Homo sapiens
aatggcaaaagttgcagatgaaga

SEQ ID NO: 36821 - DNA, 24 bp, Homo sapiens
aaatggcaaaagttgcagatgaag

SEQ ID NO: 36822 - DNA, 24 bp, Homo sapiens
taaatggcaaaagttgcagatgaa

SEQ ID NO: 36823 - DNA, 25 bp, Homo sapiens
acgggaagcaatacaatcaaacaaa

SEQ ID NO: 36824 - DNA, 25 bp, Homo sapiens
acagaagaaagtgagtgaaatggaa

SEQ ID NO: 36825 - DNA, 25 bp, Homo sapiens
aagactatcataagcaactgagtga

SEQ ID NO: 36826 - DNA, 25 bp, Homo sapiens
ggtcaagttgtgaagttctggaggc

SEQ ID NO: 36827 - DNA, 25 bp, Homo sapiens
aggatctatgagaatgccattgcgt

SEQ ID NO: 36828 - DNA, 23 bp, Homo sapiens
tgtctcactctgtcacccaggct

SEQ ID NO: 36829 - DNA, 24 bp, Homo sapiens
gagaggaaaaggtatttacttatg

SEQ ID NO: 36830 - DNA, 24 bp, Homo sapiens
agagaggaaaaggtatttacttat

SEQ ID NO: 36831 - DNA, 24 bp, Homo sapiens
gagagaggaaaaggtatttactta

SEQ ID NO: 36832 - DNA, 23 bp, Homo sapiens
atgccgaataccgacagggtgcc

SEQ ID NO: 36833 - DNA, 23 bp, Homo sapiens
cggcgtcacctctcaggctgtag

SEQ ID NO: 36834 - DNA, 23 bp, Homo sapiens
ctccctccttcccgccacccgtc

SEQ ID NO: 36835 - DNA, 24 bp, Homo sapiens
ttatcaaatgagtgagtacctttg

SEQ ID NO: 36836 - DNA, 24 bp, Homo sapiens
attatcaaatgagtgagtaccttt

SEQ ID NO: 36837 - DNA, 24 bp, Homo sapiens
aattatcaaatgagtgagtacctt

SEQ ID NO: 36838 - DNA, 24 bp, Homo sapiens
gggttggcgaatttggtacagtct

SEQ ID NO: 36839 - DNA, 25 bp, Homo sapiens
gcattaagaggctggatggatgtgt

SEQ ID NO: 36840 - DNA, 25 bp, Homo sapiens
catccttctacagatttcccttggc

SEQ ID NO: 36841 - DNA, 24 bp, Homo sapiens
ttgcatttcagaggaacatcaaga

SEQ ID NO: 36842 - DNA, 24 bp, Homo sapiens
gttgcatttcagaggaacatcaag

SEQ ID NO: 36843 - DNA, 24 bp, Homo sapiens
tgttgcatttcagaggaacatcaa

SEQ ID NO: 36844 - DNA, 24 bp, Homo sapiens
gagcttgccaaactgagaagaaca

SEQ ID NO: 36845 - DNA, 24 bp, Homo sapiens
agagcttgccaaactgagaagaac

SEQ ID NO: 36846 - DNA, 24 bp, Homo sapiens
gagagcttgccaaactgagaagaa

SEQ ID NO: 36847 - DNA, 24 bp, Homo sapiens
tgaaaaccaagaatccacctcatt

SEQ ID NO: 36848 - DNA, 24 bp, Homo sapiens
gtgaaaaccaagaatccacctcat

SEQ ID NO: 36849 - DNA, 24 bp, Homo sapiens
ggtgaaaaccaagaatccacctca

SEQ ID NO: 36850 - DNA, 24 bp, Homo sapiens
ctgagtatgaggaggaaatttcca

SEQ ID NO: 36851 - DNA, 24 bp, Homo sapiens
cctgagtatgaggaggaaatttcc

SEQ ID NO: 36852 - DNA, 24 bp, Homo sapiens
gcctgagtatgaggaggaaatttc

SEQ ID NO: 36853 - DNA, 24 bp, Homo sapiens
cggcgtgctgggctttgagctggg

SEQ ID NO: 36854 - DNA, 24 bp, Homo sapiens
acggcgtgctgggctttgagctgg

SEQ ID NO: 36855 - DNA, 24 bp, Homo sapiens
tacggcgtgctgggctttgagctg

SEQ ID NO: 36856 - DNA, 24 bp, Homo sapiens
tttaaaaatagattcagcagataa

SEQ ID NO: 36857 - DNA, 24 bp, Homo sapiens
ttttaaaaatagattcagcagata

SEQ ID NO: 36858 - DNA, 24 bp, Homo sapiens
cttttaaaaatagattcagcagat

SEQ ID NO: 36859 - DNA, 24 bp, Homo sapiens
ttttacctcaggtcacaaattggt

SEQ ID NO: 36860 - DNA, 24 bp, Homo sapiens
tttttacctcaggtcacaaattgg

SEQ ID NO: 36861 - DNA, 24 bp, Homo sapiens
ttttttacctcaggtcacaaattg

SEQ ID NO: 36862 - DNA, 24 bp, Homo sapiens
attttagaaagggtctgcttggtg

SEQ ID NO: 36863 - DNA, 24 bp, Homo sapiens
cattttagaaagggtctgcttggt

SEQ ID NO: 36864 - DNA, 24 bp, Homo sapiens
gcattttagaaagggtctgcttgg

SEQ ID NO: 36865 - DNA, 23 bp, Homo sapiens
gcctcctgcctcctccctcctcg

SEQ ID NO: 36866 - DNA, 23 bp, Homo sapiens
gggttgggctttgtagctgctcc

SEQ ID NO: 36867 - DNA, 23 bp, Homo sapiens
ggccgcgctcgcagagtcctagg

SEQ ID NO: 36868 - DNA, 25 bp, Homo sapiens
agagacctcagaagcctacctacct

SEQ ID NO: 36869 - DNA, 25 bp, Homo sapiens
acttccagcctccagaattgtgaga

SEQ ID NO: 36870 - DNA, 25 bp, Homo sapiens
acagtccttcgtcagacaccacatc

SEQ ID NO: 36871 - DNA, 25 bp, Homo sapiens
atcctgcctactgggtcgtcttctc

SEQ ID NO: 36872 - DNA, 23 bp, Homo sapiens
agcagcagaagcagtagcaagcc

SEQ ID NO: 36873 - DNA, 23 bp, Homo sapiens
tcagcacagaggaaggcagcagc

SEQ ID NO: 36874 - DNA, 24 bp, Homo sapiens
actaatgaaaggccaggaaccatc

SEQ ID NO: 36875 - DNA, 24 bp, Homo sapiens
aactaatgaaaggccaggaaccat

SEQ ID NO: 36876 - DNA, 24 bp, Homo sapiens
aaactaatgaaaggccaggaacca

SEQ ID NO: 36877 - DNA, 24 bp, Homo sapiens
tctgctgccaagtctgacaacctg

SEQ ID NO: 36878 - DNA, 24 bp, Homo sapiens
accgagagatgctggaacttctga

SEQ ID NO: 36879 - DNA, 24 bp, Homo sapiens
gcaagaaggcacaaaccaatcacg

SEQ ID NO: 36880 - DNA, 24 bp, Homo sapiens
cctgtcctcatcatcatcgtctgc

SEQ ID NO: 36881 - DNA, 24 bp, Homo sapiens
gatcctgcgtctcaagagcgtccg

SEQ ID NO: 36882 - DNA, 24 bp, Homo sapiens
gtggtggtggcagtcttcgtcgtc

SEQ ID NO: 36883 - DNA, 23 bp, Homo sapiens
cgtctggtctggcgtctgctgag

SEQ ID NO: 36884 - DNA, 25 bp, Homo sapiens
gcagaagtaccgtacagagtggatt

SEQ ID NO: 36885 - DNA, 25 bp, Homo sapiens
gttatctacggcagccaccttcagg

SEQ ID NO: 36886 - DNA, 24 bp, Homo sapiens
ctaatcatcagatcagagatccaa

SEQ ID NO: 36887 - DNA, 24 bp, Homo sapiens
actaatcatcagatcagagatcca

SEQ ID NO: 36888 - DNA, 24 bp, Homo sapiens
aactaatcatcagatcagagatcc

SEQ ID NO: 36889 - DNA, 24 bp, Homo sapiens
aggaccgctgttgctgagttcatt

SEQ ID NO: 36890 - DNA, 24 bp, Homo sapiens
gccagttgtctttgtgctcctcct

SEQ ID NO: 36891 - DNA, 24 bp, Homo sapiens
ggaacctgtcagtgctggatgtcg

SEQ ID NO: 36892 - DNA, 24 bp, Homo sapiens
cataccggagggtgcatgtacatc

SEQ ID NO: 36893 - DNA, 24 bp, Homo sapiens
ccataccggagggtgcatgtacat

SEQ ID NO: 36894 - DNA, 24 bp, Homo sapiens
accataccggagggtgcatgtaca

SEQ ID NO: 36895 - DNA, 24 bp, Homo sapiens
aaatctttcagggaactgatggag

SEQ ID NO: 36896 - DNA, 24 bp, Homo sapiens
taaatctttcagggaactgatgga

SEQ ID NO: 36897 - DNA, 24 bp, Homo sapiens
ttaaatctttcagggaactgatgg

SEQ ID NO: 36898 - DNA, 23 bp, Homo sapiens
ttggctcactgcaacctctgcct

SEQ ID NO: 36899 - DNA, 23 bp, Homo sapiens
tacgctggagtacagtggcgggc

SEQ ID NO: 36900 - DNA, 23 bp, Homo sapiens
cagcagcagcagcaacagcagca

SEQ ID NO: 36901 - DNA, 23 bp, Homo sapiens
agcagcagcagtagcagcagcag

SEQ ID NO: 36902 - DNA, 24 bp, Homo sapiens
ggtgtagtgagatgtctccagcca

SEQ ID NO: 36903 - DNA, 24 bp, Homo sapiens
ttgatttatagtatttgcctttat

SEQ ID NO: 36904 - DNA, 24 bp, Homo sapiens
cttgatttatagtatttgccttta

SEQ ID NO: 36905 - DNA, 24 bp, Homo sapiens
ccttgatttatagtatttgccttt

SEQ ID NO: 36906 - DNA, 24 bp, Homo sapiens
catcctgccgggctacgtgcaggc

SEQ ID NO: 36907 - DNA, 24 bp, Homo sapiens
tcatcctgccgggctacgtgcagg

SEQ ID NO: 36908 - DNA, 24 bp, Homo sapiens
ctcatcctgccgggctacgtgcag

SEQ ID NO: 36909 - DNA, 24 bp, Homo sapiens
tggattggtgctgtgctgtgcctc

SEQ ID NO: 36910 - DNA, 24 bp, Homo sapiens
ccaccgtgagaccaccatcgtgag

SEQ ID NO: 36911 - DNA, 24 bp, Homo sapiens
cgtttctactacactgcgggctct

SEQ ID NO: 36912 - DNA, 24 bp, Homo sapiens
ctcactctgttgctcaggctggag

SEQ ID NO: 36913 - DNA, 24 bp, Homo sapiens
gcaaacatcactgagttaggtggg

SEQ ID NO: 36914 - DNA, 24 bp, Homo sapiens
cccattcctctgccaggctctaaa

SEQ ID NO: 36915 - DNA, 24 bp, Homo sapiens
aagcgattcttgtgcctcagcctc

SEQ ID NO: 36916 - DNA, 24 bp, Homo sapiens
gacatcacatgctgagaggacagg

SEQ ID NO: 36917 - DNA, 24 bp, Homo sapiens
atggagactgaaccaggattgtgg

SEQ ID NO: 36918 - DNA, 24 bp, Homo sapiens
gctgagggcaggccaggcccccag

SEQ ID NO: 36919 - DNA, 24 bp, Homo sapiens
agctgagggcaggccaggccccca

SEQ ID NO: 36920 - DNA, 24 bp, Homo sapiens
cagctgagggcaggccaggccccc

SEQ ID NO: 36921 - DNA, 24 bp, Homo sapiens
gtccagctctgcctcgtcctctag

SEQ ID NO: 36922 - DNA, 24 bp, Homo sapiens
aagaagaagtcctctccagtgcgg

SEQ ID NO: 36923 - DNA, 24 bp, Homo sapiens
gcagagcgggagcggaaccaagag

SEQ ID NO: 36924 - DNA, 24 bp, Homo sapiens
ggcacctcaagattcaccactatg

SEQ ID NO: 36925 - DNA, 24 bp, Homo sapiens
cggaaggaggcactgctcaccatg

SEQ ID NO: 36926 - DNA, 24 bp, Homo sapiens
aggctgctgctgtctgctgctgtt

SEQ ID NO: 36927 - DNA, 24 bp, Homo sapiens
aagacatgggccacttgacagacc

SEQ ID NO: 36928 - DNA, 24 bp, Homo sapiens
aacatgagccttcgagactctagc

SEQ ID NO: 36929 - DNA, 24 bp, Homo sapiens
cttctgcccaccacagccctaccg

SEQ ID NO: 36930 - DNA, 24 bp, Homo sapiens
tggtgctggtgcgtaataagaagg

SEQ ID NO: 36931 - DNA, 24 bp, Homo sapiens
gccgccttcctcttcgagtatgac

SEQ ID NO: 36932 - DNA, 24 bp, Homo sapiens
ccagaagctctaccatcgacgtgg

SEQ ID NO: 36933 - DNA, 25 bp, Homo sapiens
aattgaccacagcacagtacagagt

SEQ ID NO: 36934 - DNA, 25 bp, Homo sapiens
ccacagcagaggaattacaggtagc

SEQ ID NO: 36935 - DNA, 24 bp, Homo sapiens
tggagttggaggacagtatgaacc

SEQ ID NO: 36936 - DNA, 24 bp, Homo sapiens
ccactttccaggtcagatgactga

SEQ ID NO: 36937 - DNA, 24 bp, Homo sapiens
cccactttccaggtcagatgactg

SEQ ID NO: 36938 - DNA, 24 bp, Homo sapiens
tcccactttccaggtcagatgact

SEQ ID NO: 36939 - DNA, 24 bp, Homo sapiens
gagagggcaaggccaaggatgcag

SEQ ID NO: 36940 - DNA, 24 bp, Homo sapiens
ggagagggcaaggccaaggatgca

SEQ ID NO: 36941 - DNA, 24 bp, Homo sapiens
aggagagggcaaggccaaggatgc

SEQ ID NO: 36942 - DNA, 24 bp, Homo sapiens
tttactttaaggtgaatttgttgc

SEQ ID NO: 36943 - DNA, 24 bp, Homo sapiens
gtttactttaaggtgaatttgttg

SEQ ID NO: 36944 - DNA, 24 bp, Homo sapiens
cgtttactttaaggtgaatttgtt

SEQ ID NO: 36945 - DNA, 25 bp, Homo sapiens
atagtgccgaggttgagaaattccg

SEQ ID NO: 36946 - DNA, 25 bp, Homo sapiens
tgtcacaactggaaggatgtactca

SEQ ID NO: 36947 - DNA, 24 bp, Homo sapiens
gtggaggccaggaatgctgctaag

SEQ ID NO: 36948 - DNA, 24 bp, Homo sapiens
gttttctgtagactaaaaaaagtg

SEQ ID NO: 36949 - DNA, 24 bp, Homo sapiens
tgttttctgtagactaaaaaaagt

SEQ ID NO: 36950 - DNA, 24 bp, Homo sapiens
atgttttctgtagactaaaaaaag

SEQ ID NO: 36951 - DNA, 24 bp, Homo sapiens
tatcttcttaggtggagcgcttta

SEQ ID NO: 36952 - DNA, 24 bp, Homo sapiens
ttatcttcttaggtggagcgcttt

SEQ ID NO: 36953 - DNA, 24 bp, Homo sapiens
cttatcttcttaggtggagcgctt

SEQ ID NO: 36954 - DNA, 24 bp, Homo sapiens
atgaaaatttgggaatttttattt

SEQ ID NO: 36955 - DNA, 24 bp, Homo sapiens
aatgaaaatttgggaatttttatt

SEQ ID NO: 36956 - DNA, 24 bp, Homo sapiens
aaatgaaaatttgggaatttttat

SEQ ID NO: 36957 - DNA, 23 bp, Homo sapiens
ggaggagcagcggcagtcagaac

SEQ ID NO: 36958 - DNA, 24 bp, Homo sapiens
cagcaggagcatgcctacctcaag

SEQ ID NO: 36959 - DNA, 23 bp, Homo sapiens
agcagcagcaacagcagcagcag

SEQ ID NO: 36960 - DNA, 23 bp, Homo sapiens
cattatggtcggggcatgaatcc

SEQ ID NO: 36961 - DNA, 23 bp, Homo sapiens
aacagcagcagcagcagctcctg

SEQ ID NO: 36962 - DNA, 23 bp, Homo sapiens
agcagcagcaacagcagcagcag

SEQ ID NO: 36963 - DNA, 23 bp, Homo sapiens
caggagaaggagcagcagcggcg

SEQ ID NO: 36964 - DNA, 24 bp, Homo sapiens
cgagcaggaatacaagcggaagca

SEQ ID NO: 36965 - DNA, 23 bp, Homo sapiens
agcagcagcaacagcagcagcag

SEQ ID NO: 36966 - DNA, 23 bp, Homo sapiens
gcagcagcagcaacagcagcagc

SEQ ID NO: 36967 - DNA, 24 bp, Homo sapiens
cgagcaggaatacaagcggaagca

SEQ ID NO: 36968 - DNA, 23 bp, Homo sapiens
caggagaaggagcagcagcggcg

SEQ ID NO: 36969 - DNA, 23 bp, Homo sapiens
ggaggagcagcggcagtcagaac

SEQ ID NO: 36970 - DNA, 23 bp, Homo sapiens
agcagcagcaacagcagcagcag

SEQ ID NO: 36971 - DNA, 23 bp, Homo sapiens
aacagcagcagcagcagctcctg

SEQ ID NO: 36972 - DNA, 24 bp, Homo sapiens
ttgtggtgctgggcctgcttccgc

SEQ ID NO: 36973 - DNA, 24 bp, Homo sapiens
gttgtggtgctgggcctgcttccg

SEQ ID NO: 36974 - DNA, 24 bp, Homo sapiens
ggttgtggtgctgggcctgcttcc

SEQ ID NO: 36975 - DNA, 24 bp, Homo sapiens
gcagcaagataccgagatgaggat

SEQ ID NO: 36976 - DNA, 25 bp, Homo sapiens
acttctcttcacaactgttcctggc

SEQ ID NO: 36977 - DNA, 23 bp, Homo sapiens
atggtggtggtgctattcctcat

SEQ ID NO: 36978 - DNA, 23 bp, Homo sapiens
atggtggtggtgctattcctcat

SEQ ID NO: 36979 - DNA, 25 bp, Homo sapiens
tggatttctggacctttgtgcctgt

SEQ ID NO: 36980 - DNA, 25 bp, Homo sapiens
cggagcaataagccagtcaccatca

SEQ ID NO: 36981 - DNA, 23 bp, Homo sapiens
cttcgtcccagtcccgcttccag

SEQ ID NO: 36982 - DNA, 23 bp, Homo sapiens
caaccacccgcacctgcctgatg

SEQ ID NO: 36983 - DNA, 23 bp, Homo sapiens
caacttcacggcgggaggagaga

SEQ ID NO: 36984 - DNA, 24 bp, Homo sapiens
tatatttgtagaatatgtttcgac

SEQ ID NO: 36985 - DNA, 24 bp, Homo sapiens
ttatatttgtagaatatgtttcga

SEQ ID NO: 36986 - DNA, 24 bp, Homo sapiens
tttatatttgtagaatatgtttcg

SEQ ID NO: 36987 - DNA, 24 bp, Homo sapiens
gcccagagcagatttgatgctact

SEQ ID NO: 36988 - DNA, 24 bp, Homo sapiens
tgcccagagcagatttgatgctac

SEQ ID NO: 36989 - DNA, 24 bp, Homo sapiens
atgcccagagcagatttgatgcta

SEQ ID NO: 36990 - DNA, 24 bp, Homo sapiens
acacacaaaaggtatgatcagcaa

SEQ ID NO: 36991 - DNA, 24 bp, Homo sapiens
cacacacaaaaggtatgatcagca

SEQ ID NO: 36992 - DNA, 24 bp, Homo sapiens
acacacacaaaaggtatgatcagc

SEQ ID NO: 36993 - DNA, 24 bp, Homo sapiens
gctgctgctggtggtgacaatgtc

SEQ ID NO: 36994 - DNA, 24 bp, Homo sapiens
ggagggagaaagtgaagcggtagc

SEQ ID NO: 36995 - DNA, 24 bp, Homo sapiens
catcatcccttccctcgcagttcc

SEQ ID NO: 36996 - DNA, 24 bp, Homo sapiens
aaaaccaaacaatactatcctctc

SEQ ID NO: 36997 - DNA, 24 bp, Homo sapiens
caaaaccaaacaatactatcctct

SEQ ID NO: 36998 - DNA, 24 bp, Homo sapiens
tcaaaaccaaacaatactatcctc

SEQ ID NO: 36999 - DNA, 25 bp, Homo sapiens
acgacattgactactatgccaagcg

SEQ ID NO: 37000 - DNA, 24 bp, Homo sapiens
gccgaggtgtggatggatgacttc

SEQ ID NO: 37001 - DNA, 25 bp, Homo sapiens
cggagatgagggtctacaacaacac

SEQ ID NO: 37002 - DNA, 25 bp, Homo sapiens
ctcagtggactcaagaagtgtctcc

SEQ ID NO: 37003 - DNA, 24 bp, Homo sapiens
ggacctggagtgaatggagtgacc

SEQ ID NO: 37004 - DNA, 24 bp, Homo sapiens
ctgctgcttctcctcctgcttgtc

SEQ ID NO: 37005 - DNA, 24 bp, Homo sapiens
ctgctgcttctcctcctgcttgtc

SEQ ID NO: 37006 - DNA, 24 bp, Homo sapiens
tcattcctgccttctggagcctga

SEQ ID NO: 37007 - DNA, 24 bp, Homo sapiens
gcctgctgcagtctcatttccagt

SEQ ID NO: 37008 - DNA, 24 bp, Homo sapiens
tgcctgctgcagtctcatttccag

SEQ ID NO: 37009 - DNA, 24 bp, Homo sapiens
gtgcctgctgcagtctcatttcca

SEQ ID NO: 37010 - DNA, 24 bp, Homo sapiens
taaaaaacctggccagaggaaaaa

SEQ ID NO: 37011 - DNA, 24 bp, Homo sapiens
ataaaaaacctggccagaggaaaa

SEQ ID NO: 37012 - DNA, 24 bp, Homo sapiens
aataaaaaacctggccagaggaaa

SEQ ID NO: 37013 - DNA, 24 bp, Homo sapiens
aactcaggaccatgatggctcagt

SEQ ID NO: 37014 - DNA, 23 bp, Homo sapiens
tgacaggctacgcaacaggttcg

SEQ ID NO: 37015 - DNA, 23 bp, Homo sapiens
ccaggctgccggtgctgagggac

SEQ ID NO: 37016 - DNA, 24 bp, Homo sapiens
ttcctgatgaggtggaatacctgc

SEQ ID NO: 37017 - DNA, 24 bp, Homo sapiens
gttcctgatgaggtggaatacctg

SEQ ID NO: 37018 - DNA, 24 bp, Homo sapiens
ggttcctgatgaggtggaatacct

SEQ ID NO: 37019 - DNA, 24 bp, Homo sapiens
tatttagataggtaagtgttttgt

SEQ ID NO: 37020 - DNA, 24 bp, Homo sapiens
ttatttagataggtaagtgttttg

SEQ ID NO: 37021 - DNA, 24 bp, Homo sapiens
attatttagataggtaagtgtttt

SEQ ID NO: 37022 - DNA, 24 bp, Homo sapiens
tccttttgcagcatccatttttaa

SEQ ID NO: 37023 - DNA, 24 bp, Homo sapiens
ttccttttgcagcatccattttta

SEQ ID NO: 37024 - DNA, 24 bp, Homo sapiens
cttccttttgcagcatccattttt

SEQ ID NO: 37025 - DNA, 24 bp, Homo sapiens
aggagagaaggactcaaatccagg

SEQ ID NO: 37026 - DNA, 24 bp, Homo sapiens
aaggagagaaggactcaaatccag

SEQ ID NO: 37027 - DNA, 24 bp, Homo sapiens
gaaggagagaaggactcaaatcca

SEQ ID NO: 37028 - DNA, 24 bp, Homo sapiens
cccggcccggggtaggtgcgcgcc

SEQ ID NO: 37029 - DNA, 24 bp, Homo sapiens
gcccggcccggggtaggtgcgcgc

SEQ ID NO: 37030 - DNA, 24 bp, Homo sapiens
agcccggcccggggtaggtgcgcg

SEQ ID NO: 37031 - DNA, 23 bp, Homo sapiens
cacggatgatcgccttcgccatg

SEQ ID NO: 37032 - DNA, 25 bp, Homo sapiens
cccagaccagcagaatttccctgac

SEQ ID NO: 37033 - DNA, 25 bp, Homo sapiens
ccaggtggtcatcaagacacagaca

SEQ ID NO: 37034 - DNA, 25 bp, Homo sapiens
ccgtgttcttcagcttgttcatggc

SEQ ID NO: 37035 - DNA, 24 bp, Homo sapiens
gtgctgctgctggagtactggaag

SEQ ID NO: 37036 - DNA, 23 bp, Homo sapiens
ctggcctaccgctgggactgctc

SEQ ID NO: 37037 - DNA, 24 bp, Homo sapiens
gagcaacgtctcctggagcctgtg

SEQ ID NO: 37038 - DNA, 24 bp, Homo sapiens
agtgacccatcctttctcgcctgc

SEQ ID NO: 37039 - DNA, 24 bp, Homo sapiens
ggcacaggcttggcacacgcactg

SEQ ID NO: 37040 - DNA, 24 bp, Homo sapiens
ctcaaggtttggaaggagacgccc

SEQ ID NO: 37041 - DNA, 24 bp, Homo sapiens
gtgcggtgtggtgctgatggactt

SEQ ID NO: 37042 - DNA, 24 bp, Homo sapiens
ccagccacgcctacatgatggacg

SEQ ID NO: 37043 - DNA, 24 bp, Homo sapiens
ggaaatcaaagaaactgatcaaag

SEQ ID NO: 37044 - DNA, 24 bp, Homo sapiens
aggaaatcaaagaaactgatcaaa

SEQ ID NO: 37045 - DNA, 24 bp, Homo sapiens
caggaaatcaaagaaactgatcaa

SEQ ID NO: 37046 - DNA, 24 bp, Homo sapiens
ttcctcacaaaaccatatctcatt

SEQ ID NO: 37047 - DNA, 24 bp, Homo sapiens
cttcctcacaaaaccatatctcat

SEQ ID NO: 37048 - DNA, 24 bp, Homo sapiens
tcttcctcacaaaaccatatctca

SEQ ID NO: 37049 - DNA, 24 bp, Homo sapiens
gccttgtgtggctggctgtcccaa

SEQ ID NO: 37050 - DNA, 24 bp, Homo sapiens
tgccttgtgtggctggctgtccca

SEQ ID NO: 37051 - DNA, 24 bp, Homo sapiens
ctgccttgtgtggctggctgtccc

SEQ ID NO: 37052 - DNA, 24 bp, Homo sapiens
tgggctgtgggtttgccttctgcc

SEQ ID NO: 37053 - DNA, 24 bp, Homo sapiens
ctgggctgtgggtttgccttctgc

SEQ ID NO: 37054 - DNA, 24 bp, Homo sapiens
cctgggctgtgggtttgccttctg

SEQ ID NO: 37055 - DNA, 24 bp, Homo sapiens
aaagctctacttgtttgtcaggtt

SEQ ID NO: 37056 - DNA, 24 bp, Homo sapiens
taaagctctacttgtttgtcaggt

SEQ ID NO: 37057 - DNA, 24 bp, Homo sapiens
ataaagctctacttgtttgtcagg

SEQ ID NO: 37058 - DNA, 24 bp, Homo sapiens
aatgtcctgtcacgattcctgagg

SEQ ID NO: 37059 - DNA, 24 bp, Homo sapiens
gttcacaggcgaatggtgcaggag

SEQ ID NO: 37060 - DNA, 24 bp, Homo sapiens
aagtgtaccaggccatagaggagg

SEQ ID NO: 37061 - DNA, 23 bp, Homo sapiens
ctgctcccgctcctctgcctccc

SEQ ID NO: 37062 - DNA, 23 bp, Homo sapiens
tgagaggcgacacggcggcggcg

SEQ ID NO: 37063 - DNA, 23 bp, Homo sapiens
cttttctcctcaagtcctgaagt

SEQ ID NO: 37064 - DNA, 24 bp, Homo sapiens
ggcgttctctacaggaggcatcac

SEQ ID NO: 37065 - DNA, 24 bp, Homo sapiens
ctacttgggtggcaggcagctctg

SEQ ID NO: 37066 - DNA, 24 bp, Homo sapiens
tcaagaaagtactaacccaaagtc

SEQ ID NO: 37067 - DNA, 24 bp, Homo sapiens
atctggaataagtggtggaatggg

SEQ ID NO: 37068 - DNA, 24 bp, Homo sapiens
gatctggaataagtggtggaatgg

SEQ ID NO: 37069 - DNA, 24 bp, Homo sapiens
ggatctggaataagtggtggaatg

SEQ ID NO: 37070 - DNA, 24 bp, Homo sapiens
gaaaatcaaggtgtggttgaattc

SEQ ID NO: 37071 - DNA, 24 bp, Homo sapiens
ggaaaatcaaggtgtggttgaatt

SEQ ID NO: 37072 - DNA, 24 bp, Homo sapiens
aggaaaatcaaggtgtggttgaat

SEQ ID NO: 37073 - DNA, 24 bp, Homo sapiens
atattaaagaggtaagatttctca

SEQ ID NO: 37074 - DNA, 24 bp, Homo sapiens
aatattaaagaggtaagatttctc

SEQ ID NO: 37075 - DNA, 24 bp, Homo sapiens
taatattaaagaggtaagatttct

SEQ ID NO: 37076 - DNA, 25 bp, Homo sapiens
agaagggtccaaatcgtaacagagt

SEQ ID NO: 37077 - DNA, 23 bp, Homo sapiens
gagaagcagcagccgcagcacag

SEQ ID NO: 37078 - DNA, 25 bp, Homo sapiens
gcaacatcccatatgacatgaaatg

SEQ ID NO: 37079 - DNA, 25 bp, Homo sapiens
agtaaccacagagtaacacatgcct

SEQ ID NO: 37080 - DNA, 25 bp, Homo sapiens
cgctattgattaggaagactgagaa

SEQ ID NO: 37081 - DNA, 25 bp, Homo sapiens
atttcaccatctgtgggtaacctca

SEQ ID NO: 37082 - DNA, 24 bp, Homo sapiens
aaatcaatacggtgggtgggacaa

SEQ ID NO: 37083 - DNA, 24 bp, Homo sapiens
aaaatcaatacggtgggtgggaca

SEQ ID NO: 37084 - DNA, 24 bp, Homo sapiens
aaaaatcaatacggtgggtgggac

SEQ ID NO: 37085 - DNA, 24 bp, Homo sapiens
gcggggcacagaaattggcgtgtt

SEQ ID NO: 37086 - DNA, 24 bp, Homo sapiens
tgcggggcacagaaattggcgtgt

SEQ ID NO: 37087 - DNA, 24 bp, Homo sapiens
ctgcggggcacagaaattggcgtg

SEQ ID NO: 37088 - DNA, 24 bp, Homo sapiens
taactatcaaatgcatttgctgaa

SEQ ID NO: 37089 - DNA, 24 bp, Homo sapiens
ctaactatcaaatgcatttgctga

SEQ ID NO: 37090 - DNA, 24 bp, Homo sapiens
tctaactatcaaatgcatttgctg

SEQ ID NO: 37091 - DNA, 24 bp, Homo sapiens
gagaacccagccagtcaggaagtc

SEQ ID NO: 37092 - DNA, 23 bp, Homo sapiens
tcgggaacaccaaccaatcaggg

SEQ ID NO: 37093 - DNA, 23 bp, Homo sapiens
ttcggctcactgcaacctcctcc

SEQ ID NO: 37094 - DNA, 23 bp, Homo sapiens
cggcagcagcatcaaccatctct

SEQ ID NO: 37095 - DNA, 24 bp, Homo sapiens
acaacttgcggctatccagatggc

SEQ ID NO: 37096 - DNA, 23 bp, Homo sapiens
agagaatgatctggtgcgaagcc

SEQ ID NO: 37097 - DNA, 24 bp, Homo sapiens
atatttgacagaaactatgtgaag

SEQ ID NO: 37098 - DNA, 24 bp, Homo sapiens
tatatttgacagaaactatgtgaa

SEQ ID NO: 37099 - DNA, 24 bp, Homo sapiens
gtatatttgacagaaactatgtga

SEQ ID NO: 37100 - DNA, 24 bp, Homo sapiens
gatgacaaaaggtaaagcttcctt

SEQ ID NO: 37101 - DNA, 24 bp, Homo sapiens
ggatgacaaaaggtaaagcttcct

SEQ ID NO: 37102 - DNA, 24 bp, Homo sapiens
aggatgacaaaaggtaaagcttcc

SEQ ID NO: 37103 - DNA, 23 bp, Homo sapiens
ggaatgacaagtggtgcctggat

SEQ ID NO: 37104 - DNA, 25 bp, Homo sapiens
gcagacagacaaccacccaaagacc

SEQ ID NO: 37105 - DNA, 24 bp, Homo sapiens
tccttctgagcaacacccaaacgc

SEQ ID NO: 37106 - DNA, 25 bp, Homo sapiens
gagcctacggttacttggagacaca

SEQ ID NO: 37107 - DNA, 25 bp, Homo sapiens
cggttggctttgtgagtgaagacga

SEQ ID NO: 37108 - DNA, 23 bp, Homo sapiens
attcagggcatcaccagggagca

SEQ ID NO: 37109 - DNA, 25 bp, Homo sapiens
tcagaagccaagggtacaggtgtcc

SEQ ID NO: 37110 - DNA, 23 bp, Homo sapiens
attcagggcatcaccagggagca

SEQ ID NO: 37111 - DNA, 25 bp, Homo sapiens
cggttggctttgtgagtgaagacga

SEQ ID NO: 37112 - DNA, 24 bp, Homo sapiens
catgctatttgaagtgaaaactac

SEQ ID NO: 37113 - DNA, 24 bp, Homo sapiens
tcatgctatttgaagtgaaaacta

SEQ ID NO: 37114 - DNA, 24 bp, Homo sapiens
atcatgctatttgaagtgaaaact

SEQ ID NO: 37115 - DNA, 24 bp, Homo sapiens
tctcacagtaggaaataatacagc

SEQ ID NO: 37116 - DNA, 24 bp, Homo sapiens
ttctcacagtaggaaataatacag

SEQ ID NO: 37117 - DNA, 24 bp, Homo sapiens
tttctcacagtaggaaataataca

SEQ ID NO: 37118 - DNA, 24 bp, Homo sapiens
aatacgagcaggcctgcaacgagt

SEQ ID NO: 37119 - DNA, 24 bp, Homo sapiens
aaatacgagcaggcctgcaacgag

SEQ ID NO: 37120 - DNA, 24 bp, Homo sapiens
gaaatacgagcaggcctgcaacga

SEQ ID NO: 37121 - DNA, 24 bp, Homo sapiens
caagaatgcttggattaatgaaaa

SEQ ID NO: 37122 - DNA, 24 bp, Homo sapiens
gcaagaatgcttggattaatgaaa

SEQ ID NO: 37123 - DNA, 24 bp, Homo sapiens
agcaagaatgcttggattaatgaa

SEQ ID NO: 37124 - DNA, 23 bp, Homo sapiens
gaatccgccgaacctccaccgcc

SEQ ID NO: 37125 - DNA, 25 bp, Homo sapiens
cagaggtgagattgccatccgtgtg

SEQ ID NO: 37126 - DNA, 25 bp, Homo sapiens
agccatctactctgagcaggacacg

SEQ ID NO: 37127 - DNA, 25 bp, Homo sapiens
gctgaccaaacactaaggatgctga

SEQ ID NO: 37128 - DNA, 23 bp, Homo sapiens
gaatccgccgaacctccaccgcc

SEQ ID NO: 37129 - DNA, 25 bp, Homo sapiens
cagaggtgagattgccatccgtgtg

SEQ ID NO: 37130 - DNA, 24 bp, Homo sapiens
ggcaggagaacatccgcatcaacg

SEQ ID NO: 37131 - DNA, 23 bp, Homo sapiens
cttccaaggagccgtcatctcgc

SEQ ID NO: 37132 - DNA, 24 bp, Homo sapiens
tccctgctggtcaaagtcattgcc

SEQ ID NO: 37133 - DNA, 24 bp, Homo sapiens
tgaacgggcagatggtggactaca

SEQ ID NO: 37134 - DNA, 23 bp, Homo sapiens
cggaggcttcctaaccaatggcg

SEQ ID NO: 37135 - DNA, 24 bp, Homo sapiens
cgggcacagcaactctctaaccag

SEQ ID NO: 37136 - DNA, 23 bp, Homo sapiens
tggacgcctatgaaggtgcctca

SEQ ID NO: 37137 - DNA, 25 bp, Homo sapiens
gccagaggagagtattagcaatgaa

SEQ ID NO: 37138 - DNA, 25 bp, Homo sapiens
caccaccagcaccttgaagaagaat

SEQ ID NO: 37139 - DNA, 23 bp, Homo sapiens
ccacttacaggcactcctccagg

SEQ ID NO: 37140 - DNA, 23 bp, Homo sapiens
accagctctcaacggtggatgcc

SEQ ID NO: 37141 - DNA, 23 bp, Homo sapiens
atcagcctcacaccacccaccac

SEQ ID NO: 37142 - DNA, 25 bp, Homo sapiens
ggctcatctccagtgacctctagtg

SEQ ID NO: 37143 - DNA, 25 bp, Homo sapiens
agcaagcagcaacagttctcagtct

SEQ ID NO: 37144 - DNA, 25 bp, Homo sapiens
aagtgcctatgttatcttccctggg

SEQ ID NO: 37145 - DNA, 24 bp, Homo sapiens
gaaaattcaagaatgcctgttatt

SEQ ID NO: 37146 - DNA, 24 bp, Homo sapiens
agaaaattcaagaatgcctgttat

SEQ ID NO: 37147 - DNA, 24 bp, Homo sapiens
aagaaaattcaagaatgcctgtta

SEQ ID NO: 37148 - DNA, 24 bp, Homo sapiens
gggcccaagctgcagcagaagatg

SEQ ID NO: 37149 - DNA, 24 bp, Homo sapiens
agggcccaagctgcagcagaagat

SEQ ID NO: 37150 - DNA, 24 bp, Homo sapiens
cagggcccaagctgcagcagaaga

SEQ ID NO: 37151 - DNA, 24 bp, Homo sapiens
ggcaccagcggctcccaaaatggc

SEQ ID NO: 37152 - DNA, 24 bp, Homo sapiens
cggcaccagcggctcccaaaatgg

SEQ ID NO: 37153 - DNA, 24 bp, Homo sapiens
ccggcaccagcggctcccaaaatg

SEQ ID NO: 37154 - DNA, 25 bp, Homo sapiens
ccaactacgcagacacgctccttag

SEQ ID NO: 37155 - DNA, 23 bp, Homo sapiens
ccttcgtcatcgtgctgctggtg

SEQ ID NO: 37156 - DNA, 24 bp, Homo sapiens
ctctatcttgtggtggcagtggct

SEQ ID NO: 37157 - DNA, 23 bp, Homo sapiens
ctctccgccactgtcacgctcac

SEQ ID NO: 37158 - DNA, 23 bp, Homo sapiens
caggaggcggcttgacaggtgtg

SEQ ID NO: 37159 - DNA, 23 bp, Homo sapiens
ccttcgtcatcgtgctgctggcg

SEQ ID NO: 37160 - DNA, 24 bp, Homo sapiens
ggagcggactgcaagccccgccca

SEQ ID NO: 37161 - DNA, 24 bp, Homo sapiens
aggagcggactgcaagccccgccc

SEQ ID NO: 37162 - DNA, 24 bp, Homo sapiens
gaggagcggactgcaagccccgcc

SEQ ID NO: 37163 - DNA, 24 bp, Homo sapiens
cctgggatgggaagctgctgatgg

SEQ ID NO: 37164 - DNA, 24 bp, Homo sapiens
ccctgggatgggaagctgctgatg

SEQ ID NO: 37165 - DNA, 24 bp, Homo sapiens
gccctgggatgggaagctgctgat

SEQ ID NO: 37166 - DNA, 24 bp, Homo sapiens
acagcaaacagccatttcgtagag

SEQ ID NO: 37167 - DNA, 24 bp, Homo sapiens
tacagcaaacagccatttcgtaga

SEQ ID NO: 37168 - DNA, 24 bp, Homo sapiens
gtacagcaaacagccatttcgtag

SEQ ID NO: 37169 - DNA, 23 bp, Homo sapiens
catcatcgccatcgccaccacct

SEQ ID NO: 37170 - DNA, 23 bp, Homo sapiens
cgctgatcgtcatcatcgtgctg

SEQ ID NO: 37171 - DNA, 23 bp, Homo sapiens
gctcaccaccaccgcaactgtca

SEQ ID NO: 37172 - DNA, 24 bp, Homo sapiens
tcttttgacaggaattaatatttt

SEQ ID NO: 37173 - DNA, 24 bp, Homo sapiens
gtcttttgacaggaattaatattt

SEQ ID NO: 37174 - DNA, 24 bp, Homo sapiens
tgtcttttgacaggaattaatatt

SEQ ID NO: 37175 - DNA, 24 bp, Homo sapiens
gtcttttacagaataccaggaaaa

SEQ ID NO: 37176 - DNA, 24 bp, Homo sapiens
tgtcttttacagaataccaggaaa

SEQ ID NO: 37177 - DNA, 24 bp, Homo sapiens
ttgtcttttacagaataccaggaa

SEQ ID NO: 37178 - DNA, 25 bp, Homo sapiens
ctcacgcctgtaatcccagcacttt

SEQ ID NO: 37179 - DNA, 23 bp, Homo sapiens
aatcatcgcagaatgggccgagc

SEQ ID NO: 37180 - DNA, 23 bp, Homo sapiens
gcagatggcacgcacaccaaccc

SEQ ID NO: 37181 - DNA, 23 bp, Homo sapiens
caggccgctgcatcttctatggg

SEQ ID NO: 37182 - DNA, 23 bp, Homo sapiens
ggcatcgtggggctcctgaccag

SEQ ID NO: 37183 - DNA, 25 bp, Homo sapiens
ggttcaagtgattctcctgcctcag

SEQ ID NO: 37184 - DNA, 25 bp, Homo sapiens
gcatattctcagagcctaccaggaa

SEQ ID NO: 37185 - DNA, 24 bp, Homo sapiens
caatctccgctcactgcaacctgt

SEQ ID NO: 37186 - DNA, 24 bp, Homo sapiens
tcaaataatgggtaagaaagaata

SEQ ID NO: 37187 - DNA, 24 bp, Homo sapiens
ctcaaataatgggtaagaaagaat

SEQ ID NO: 37188 - DNA, 24 bp, Homo sapiens
gctcaaataatgggtaagaaagaa

SEQ ID NO: 37189 - DNA, 24 bp, Homo sapiens
cctggcgtctgagtctctggcgta

SEQ ID NO: 37190 - DNA, 24 bp, Homo sapiens
cggctggtcctgggtctggtctcc

SEQ ID NO: 37191 - DNA, 24 bp, Homo sapiens
gaggtgctagagcttcgcaacgag

SEQ ID NO: 37192 - DNA, 24 bp, Homo sapiens
tgggctcagaattggttccttccg

SEQ ID NO: 37193 - DNA, 25 bp, Homo sapiens
ggagtgcagtgtcacaatcacagct

SEQ ID NO: 37194 - DNA, 24 bp, Homo sapiens
ttggtctcactgacttcaagaatg

SEQ ID NO: 37195 - DNA, 24 bp, Homo sapiens
ttcataaaatattggatgcagtgt

SEQ ID NO: 37196 - DNA, 24 bp, Homo sapiens
cttcataaaatattggatgcagtg

SEQ ID NO: 37197 - DNA, 24 bp, Homo sapiens
ccttcataaaatattggatgcagt

SEQ ID NO: 37198 - DNA, 25 bp, Homo sapiens
tgaacctcagtttccttgtctgtga

SEQ ID NO: 37199 - DNA, 25 bp, Homo sapiens
gggttctggaagatgaaatgagtgt

SEQ ID NO: 37200 - DNA, 25 bp, Homo sapiens
ataagtattggctaaagttggtcct

SEQ ID NO: 37201 - DNA, 24 bp, Homo sapiens
gcctttacaaagtaagtgtattat

SEQ ID NO: 37202 - DNA, 24 bp, Homo sapiens
tgcctttacaaagtaagtgtatta

SEQ ID NO: 37203 - DNA, 24 bp, Homo sapiens
ctgcctttacaaagtaagtgtatt

SEQ ID NO: 37204 - DNA, 24 bp, Homo sapiens
cacatgctggttctgggtataacc

SEQ ID NO: 37205 - DNA, 24 bp, Homo sapiens
gcacatgctggttctgggtataac

SEQ ID NO: 37206 - DNA, 24 bp, Homo sapiens
agcacatgctggttctgggtataa

SEQ ID NO: 37207 - DNA, 24 bp, Homo sapiens
ctgtttaacaggcaaaatcatcat

SEQ ID NO: 37208 - DNA, 24 bp, Homo sapiens
tctgtttaacaggcaaaatcatca

SEQ ID NO: 37209 - DNA, 24 bp, Homo sapiens
ctctgtttaacaggcaaaatcatc

SEQ ID NO: 37210 - DNA, 24 bp, Homo sapiens
aaaatgagaaagtatgtattgagt

SEQ ID NO: 37211 - DNA, 24 bp, Homo sapiens
gaaaatgagaaagtatgtattgag

SEQ ID NO: 37212 - DNA, 24 bp, Homo sapiens
ggaaaatgagaaagtatgtattga

SEQ ID NO: 37213 - DNA, 24 bp, Homo sapiens
ttctttaaaagagactgaatggtg

SEQ ID NO: 37214 - DNA, 24 bp, Homo sapiens
attctttaaaagagactgaatggt

SEQ ID NO: 37215 - DNA, 24 bp, Homo sapiens
tattctttaaaagagactgaatgg

SEQ ID NO: 37216 - DNA, 24 bp, Homo sapiens
ggcgggaacaccatctattgttgg

SEQ ID NO: 37217 - DNA, 24 bp, Homo sapiens
aggcgggaacaccatctattgttg

SEQ ID NO: 37218 - DNA, 24 bp, Homo sapiens
aaggcgggaacaccatctattgtt

SEQ ID NO: 37219 - DNA, 24 bp, Homo sapiens
taatattataggtctggcccctct

SEQ ID NO: 37220 - DNA, 24 bp, Homo sapiens
ttaatattataggtctggcccctc

SEQ ID NO: 37221 - DNA, 24 bp, Homo sapiens
attaatattataggtctggcccct

SEQ ID NO: 37222 - DNA, 23 bp, Homo sapiens
gcggctatggtggcaactccctg

SEQ ID NO: 37223 - DNA, 23 bp, Homo sapiens
ctttgccctacgcatcgcctctc

SEQ ID NO: 37224 - DNA, 25 bp, Homo sapiens
gcaacccagagaaaaccctgattgg

SEQ ID NO: 37225 - DNA, 24 bp, Homo sapiens
attaaagaaagctctggaatcaac

SEQ ID NO: 37226 - DNA, 24 bp, Homo sapiens
cattaaagaaagctctggaatcaa

SEQ ID NO: 37227 - DNA, 24 bp, Homo sapiens
tcattaaagaaagctctggaatca

SEQ ID NO: 37228 - DNA, 24 bp, Homo sapiens
ggttcaagcgattctcctgcctca

SEQ ID NO: 37229 - DNA, 23 bp, Homo sapiens
ggagttacataggtgcctgccgc

SEQ ID NO: 37230 - DNA, 25 bp, Homo sapiens
cttaggcgggtggattgcttgagtc

SEQ ID NO: 37231 - DNA, 24 bp, Homo sapiens
ccatgttacaggccacagcagaag

SEQ ID NO: 37232 - DNA, 24 bp, Homo sapiens
tccatgttacaggccacagcagaa

SEQ ID NO: 37233 - DNA, 24 bp, Homo sapiens
atccatgttacaggccacagcaga

SEQ ID NO: 37234 - DNA, 23 bp, Homo sapiens
gagtctgagcgaactgcgcccag

SEQ ID NO: 37235 - DNA, 23 bp, Homo sapiens
gagcctcccaccgccagcaacct

SEQ ID NO: 37236 - DNA, 23 bp, Homo sapiens
cgcctcaccgccaccagctcctg

SEQ ID NO: 37237 - DNA, 25 bp, Homo sapiens
ttagattagtctgaagccgccacca

SEQ ID NO: 37238 - DNA, 23 bp, Homo sapiens
ttggagagtccggccccgaggag

SEQ ID NO: 37239 - DNA, 23 bp, Homo sapiens
ctgccctgcaccgccctcctgga

SEQ ID NO: 37240 - DNA, 23 bp, Homo sapiens
tcacggctgcggaagaggaggtt

SEQ ID NO: 37241 - DNA, 25 bp, Homo sapiens
ccagaccaaggcagaataatctccg

SEQ ID NO: 37242 - DNA, 23 bp, Homo sapiens
ctgctgggaggctgctggatagg

SEQ ID NO: 37243 - DNA, 24 bp, Homo sapiens
ttctcttttaggtattttcaacca

SEQ ID NO: 37244 - DNA, 24 bp, Homo sapiens
cttctcttttaggtattttcaacc

SEQ ID NO: 37245 - DNA, 24 bp, Homo sapiens
tcttctcttttaggtattttcaac

SEQ ID NO: 37246 - DNA, 25 bp, Homo sapiens
ctcccaggttcaagtgattgtccca

SEQ ID NO: 37247 - DNA, 24 bp, Homo sapiens
caatggtgcgatcttggctcatca

SEQ ID NO: 37248 - DNA, 25 bp, Homo sapiens
actgggagtcgttagtgagagtttc

SEQ ID NO: 37249 - DNA, 24 bp, Homo sapiens
aggagtggcaggctgcttggctcc

SEQ ID NO: 37250 - DNA, 24 bp, Homo sapiens
aaggagtggcaggctgcttggctc

SEQ ID NO: 37251 - DNA, 24 bp, Homo sapiens
aaaggagtggcaggctgcttggct

SEQ ID NO: 37252 - DNA, 24 bp, Homo sapiens
cctccccgctgccgcctcctcctg

SEQ ID NO: 37253 - DNA, 24 bp, Homo sapiens
ggtgtctcgtcccctcgcggagcc

SEQ ID NO: 37254 - DNA, 24 bp, Homo sapiens
gcaggctccgctgttagaatcaca

SEQ ID NO: 37255 - DNA, 24 bp, Homo sapiens
gatggtggctcacgcttgtaatcc

SEQ ID NO: 37256 - DNA, 25 bp, Homo sapiens
tccaaagtcacctctgtcaaagcca

SEQ ID NO: 37257 - DNA, 24 bp, Homo sapiens
gcaggctccgctgttagaatcaca

SEQ ID NO: 37258 - DNA, 23 bp, Homo sapiens
aatccggcatctggtcgctgagt

SEQ ID NO: 37259 - DNA, 24 bp, Homo sapiens
ggatggtggctcacgcttgtaatc

SEQ ID NO: 37260 - DNA, 24 bp, Homo sapiens
gaaaaactccagaagttaaatgaa

SEQ ID NO: 37261 - DNA, 24 bp, Homo sapiens
tgaaaaactccagaagttaaatga

SEQ ID NO: 37262 - DNA, 24 bp, Homo sapiens
ctgaaaaactccagaagttaaatg

SEQ ID NO: 37263 - DNA, 24 bp, Homo sapiens
tttaattgtagagagaaattttat

SEQ ID NO: 37264 - DNA, 24 bp, Homo sapiens
atttaattgtagagagaaatttta

SEQ ID NO: 37265 - DNA, 24 bp, Homo sapiens
aatttaattgtagagagaaatttt

SEQ ID NO: 37266 - DNA, 24 bp, Homo sapiens
tgaggaggaggaggaagaagcaga

SEQ ID NO: 37267 - DNA, 24 bp, Homo sapiens
aggagcagtctggttgatgagcat

SEQ ID NO: 37268 - DNA, 24 bp, Homo sapiens
gaagatcaaccgacttatggctgc

SEQ ID NO: 37269 - DNA, 24 bp, Homo sapiens
agaagactcagactctggaagctg

SEQ ID NO: 37270 - DNA, 24 bp, Homo sapiens
aagaagactcagactctggaagct

SEQ ID NO: 37271 - DNA, 24 bp, Homo sapiens
caagaagactcagactctggaagc

SEQ ID NO: 37272 - DNA, 24 bp, Homo sapiens
aatatatttgggtaaagttgtaag

SEQ ID NO: 37273 - DNA, 24 bp, Homo sapiens
gaatatatttgggtaaagttgtaa

SEQ ID NO: 37274 - DNA, 24 bp, Homo sapiens
ggaatatatttgggtaaagttgta

SEQ ID NO: 37275 - DNA, 23 bp, Homo sapiens
tggaggcggcagcggtggctaca

SEQ ID NO: 37276 - DNA, 23 bp, Homo sapiens
cggtactggacccggcgggatga

SEQ ID NO: 37277 - DNA, 23 bp, Homo sapiens
gggaggggccggggcggtggcgg

SEQ ID NO: 37278 - DNA, 23 bp, Homo sapiens
cgtaagtcccgccgattcatccc

SEQ ID NO: 37279 - DNA, 24 bp, Homo sapiens
cctcccaaccagcagcagcctata

SEQ ID NO: 37280 - DNA, 23 bp, Homo sapiens
caccaacagcagggagatgagcg

SEQ ID NO: 37281 - DNA, 24 bp, Homo sapiens
tcctattttaggtttgaaagagaa

SEQ ID NO: 37282 - DNA, 24 bp, Homo sapiens
ttcctattttaggtttgaaagaga

SEQ ID NO: 37283 - DNA, 24 bp, Homo sapiens
tttcctattttaggtttgaaagag

SEQ ID NO: 37284 - DNA, 24 bp, Homo sapiens
ttgaagagaaggtaaattaactta

SEQ ID NO: 37285 - DNA, 24 bp, Homo sapiens
attgaagagaaggtaaattaactt

SEQ ID NO: 37286 - DNA, 24 bp, Homo sapiens
aattgaagagaaggtaaattaact

SEQ ID NO: 37287 - DNA, 23 bp, Homo sapiens
atgtccgtgtgaagatgctggcg

SEQ ID NO: 37288 - DNA, 25 bp, Homo sapiens
gattccttcctgaactgcctgctgt

SEQ ID NO: 37289 - DNA, 25 bp, Homo sapiens
ctgatccaagttccgagtgacatcc

SEQ ID NO: 37290 - DNA, 23 bp, Homo sapiens
cgcttgtctatgggcaccacggg

SEQ ID NO: 37291 - DNA, 23 bp, Homo sapiens
tgtcacggacctgccgcctcctc

SEQ ID NO: 37292 - DNA, 23 bp, Homo sapiens
cagtaccctgtggcgggtgcgaa

SEQ ID NO: 37293 - DNA, 23 bp, Homo sapiens
cgcttgtctatgggcaccacggg

SEQ ID NO: 37294 - DNA, 23 bp, Homo sapiens
gacctgccgcctcctcctactcc

SEQ ID NO: 37295 - DNA, 23 bp, Homo sapiens
tctgtgttggttggagcgagcat

SEQ ID NO: 37296 - DNA, 24 bp, Homo sapiens
gtttaaaataggattttaaagctg

SEQ ID NO: 37297 - DNA, 24 bp, Homo sapiens
tgtttaaaataggattttaaagct

SEQ ID NO: 37298 - DNA, 24 bp, Homo sapiens
ttgtttaaaataggattttaaagc

SEQ ID NO: 37299 - DNA, 23 bp, Homo sapiens
gccgggcagcggggcctgggacg

SEQ ID NO: 37300 - DNA, 23 bp, Homo sapiens
ttttggtgattaattttctgggg

SEQ ID NO: 37301 - DNA, 24 bp, Homo sapiens
gattttactctccatttttctctg

SEQ ID NO: 37302 - DNA, 24 bp, Homo sapiens
ctgccatccctgtatttgctgcca

SEQ ID NO: 37303 - DNA, 24 bp, Homo sapiens
cttcttcgcctttgagtgccgcta

SEQ ID NO: 37304 - DNA, 25 bp, Homo sapiens
tgtgatggtggtgagaaagaaggtg

SEQ ID NO: 37305 - DNA, 23 bp, Homo sapiens
tctcgtctccctgcgggaccttc

SEQ ID NO: 37306 - DNA, 23 bp, Homo sapiens
cgccttctgcctttccgacgtgg

SEQ ID NO: 37307 - DNA, 23 bp, Homo sapiens
aggtcatggcgctggctgctcga

SEQ ID NO: 37308 - DNA, 24 bp, Homo sapiens
ggacagcgcgggtcagcgggcgtg

SEQ ID NO: 37309 - DNA, 24 bp, Homo sapiens
tggacagcgcgggtcagcgggcgt

SEQ ID NO: 37310 - DNA, 24 bp, Homo sapiens
gtggacagcgcgggtcagcgggcg

SEQ ID NO: 37311 - DNA, 23 bp, Homo sapiens
gcgtcactgcaacctctgcctcc

SEQ ID NO: 37312 - DNA, 24 bp, Homo sapiens
gcattaaaaaccagcatagtctca

SEQ ID NO: 37313 - DNA, 23 bp, Homo sapiens
cccaggctgcagtgcagtggtgc

SEQ ID NO: 37314 - DNA, 24 bp, Homo sapiens
gtaattactgcacataaaatgata

SEQ ID NO: 37315 - DNA, 24 bp, Homo sapiens
agtaattactgcacataaaatgat

SEQ ID NO: 37316 - DNA, 24 bp, Homo sapiens
aagtaattactgcacataaaatga

SEQ ID NO: 37317 - DNA, 24 bp, Homo sapiens
attatgagaaggttctgaagaaag

SEQ ID NO: 37318 - DNA, 24 bp, Homo sapiens
cattatgagaaggttctgaagaaa

SEQ ID NO: 37319 - DNA, 24 bp, Homo sapiens
tcattatgagaaggttctgaagaa

SEQ ID NO: 37320 - DNA, 23 bp, Homo sapiens
ggtcctccgcgtctccagtcctc

SEQ ID NO: 37321 - DNA, 25 bp, Homo sapiens
aggctacctaagaggatgagcggtg

SEQ ID NO: 37322 - DNA, 23 bp, Homo sapiens
gccgccaccgccgtgctactgag

SEQ ID NO: 37323 - DNA, 24 bp, Homo sapiens
ggaatttataactaaattttcagg

SEQ ID NO: 37324 - DNA, 24 bp, Homo sapiens
aggaatttataactaaattttcag

SEQ ID NO: 37325 - DNA, 24 bp, Homo sapiens
gaggaatttataactaaattttca

SEQ ID NO: 37326 - DNA, 24 bp, Homo sapiens
gcccccaccaggtattcctagtcg

SEQ ID NO: 37327 - DNA, 24 bp, Homo sapiens
tgcccccaccaggtattcctagtc

SEQ ID NO: 37328 - DNA, 24 bp, Homo sapiens
ttgcccccaccaggtattcctagt

SEQ ID NO: 37329 - DNA, 25 bp, Homo sapiens
ctcaagaaggatggaagaagttagc

SEQ ID NO: 37330 - DNA, 24 bp, Homo sapiens
aacaccatcaacatatgtgcgctg

SEQ ID NO: 37331 - DNA, 25 bp, Homo sapiens
tgttggactaattaggaagctgtca

SEQ ID NO: 37332 - DNA, 24 bp, Homo sapiens
gtaaatatttggaatagaagatga

SEQ ID NO: 37333 - DNA, 24 bp, Homo sapiens
agtaaatatttggaatagaagatg

SEQ ID NO: 37334 - DNA, 24 bp, Homo sapiens
cagtaaatatttggaatagaagat

SEQ ID NO: 37335 - DNA, 24 bp, Homo sapiens
ttaaatctaagcttttggaatttt

SEQ ID NO: 37336 - DNA, 24 bp, Homo sapiens
tttaaatctaagcttttggaattt

SEQ ID NO: 37337 - DNA, 24 bp, Homo sapiens
ttttaaatctaagcttttggaatt

SEQ ID NO: 37338 - DNA, 24 bp, Homo sapiens
ttttaaacaagtggtaaatgagaa

SEQ ID NO: 37339 - DNA, 24 bp, Homo sapiens
tttttaaacaagtggtaaatgaga

SEQ ID NO: 37340 - DNA, 24 bp, Homo sapiens
ttttttaaacaagtggtaaatgag

SEQ ID NO: 37341 - DNA, 24 bp, Homo sapiens
ttacatcctagacagtacaatgta

SEQ ID NO: 37342 - DNA, 24 bp, Homo sapiens
gttacatcctagacagtacaatgt

SEQ ID NO: 37343 - DNA, 24 bp, Homo sapiens
tgttacatcctagacagtacaatg

SEQ ID NO: 37344 - DNA, 24 bp, Homo sapiens
acaggacaaaagtatagtaaatag

SEQ ID NO: 37345 - DNA, 24 bp, Homo sapiens
aacaggacaaaagtatagtaaata

SEQ ID NO: 37346 - DNA, 24 bp, Homo sapiens
aaacaggacaaaagtatagtaaat

SEQ ID NO: 37347 - DNA, 23 bp, Homo sapiens
ctggctgaggttgaggcggtatg

SEQ ID NO: 37348 - DNA, 25 bp, Homo sapiens
caactctgatggcacataggcggaa

SEQ ID NO: 37349 - DNA, 25 bp, Homo sapiens
tgtcgtccagaccattcagactgtc

SEQ ID NO: 37350 - DNA, 23 bp, Homo sapiens
ccctcagatgagagctgcaccca

SEQ ID NO: 37351 - DNA, 23 bp, Homo sapiens
gaagccgaagccgcacctcccgc

SEQ ID NO: 37352 - DNA, 24 bp, Homo sapiens
ctagccgtcgcttacctaggatgc

SEQ ID NO: 37353 - DNA, 24 bp, Homo sapiens
gtctgttgtagatcaaacaagatg

SEQ ID NO: 37354 - DNA, 24 bp, Homo sapiens
tgtctgttgtagatcaaacaagat

SEQ ID NO: 37355 - DNA, 24 bp, Homo sapiens
ttgtctgttgtagatcaaacaaga

SEQ ID NO: 37356 - DNA, 24 bp, Homo sapiens
tgttttcatagaaaatgtggacac

SEQ ID NO: 37357 - DNA, 24 bp, Homo sapiens
ctgttttcatagaaaatgtggaca

SEQ ID NO: 37358 - DNA, 24 bp, Homo sapiens
cctgttttcatagaaaatgtggac

SEQ ID NO: 37359 - DNA, 24 bp, Homo sapiens
gctttttccagttagagaatcttc

SEQ ID NO: 37360 - DNA, 24 bp, Homo sapiens
tgctttttccagttagagaatctt

SEQ ID NO: 37361 - DNA, 24 bp, Homo sapiens
ttgctttttccagttagagaatct

SEQ ID NO: 37362 - DNA, 24 bp, Homo sapiens
tcccatgatgctgctttggagccg

SEQ ID NO: 37363 - DNA, 24 bp, Homo sapiens
cacccacagcctcgcatggatggt

SEQ ID NO: 37364 - DNA, 24 bp, Homo sapiens
caggtggagctggacaggcggcag

SEQ ID NO: 37365 - DNA, 23 bp, Homo sapiens
ggacacagcagcggccaccatgg

SEQ ID NO: 37366 - DNA, 23 bp, Homo sapiens
gcaagggctagggtccatctcca

SEQ ID NO: 37367 - DNA, 23 bp, Homo sapiens
gaggtgcctccaggcggccagtg

SEQ ID NO: 37368 - DNA, 24 bp, Homo sapiens
agaccagatagaaccatctatagg

SEQ ID NO: 37369 - DNA, 24 bp, Homo sapiens
gagaccagatagaaccatctatag

SEQ ID NO: 37370 - DNA, 24 bp, Homo sapiens
ggagaccagatagaaccatctata

SEQ ID NO: 37371 - DNA, 24 bp, Homo sapiens
ttccagatgacccagccaagacca

SEQ ID NO: 37372 - DNA, 25 bp, Homo sapiens
ctagagatgtgggcatggcagacaa

SEQ ID NO: 37373 - DNA, 23 bp, Homo sapiens
agctagtggcggttggcaggaac

SEQ ID NO: 37374 - DNA, 25 bp, Homo sapiens
ccaggaggagcaggaggagtacatc

SEQ ID NO: 37375 - DNA, 25 bp, Homo sapiens
gcatcaacctcatctcactgaagcc

SEQ ID NO: 37376 - DNA, 23 bp, Homo sapiens
atccttgacgaccagtgttgctt

SEQ ID NO: 37377 - DNA, 23 bp, Homo sapiens
cagagtggaggtgccaggtggag

SEQ ID NO: 37378 - DNA, 25 bp, Homo sapiens
gatgaggaggagtctggtgaagttc

SEQ ID NO: 37379 - DNA, 23 bp, Homo sapiens
cgccacaagatcatcctgctgca

SEQ ID NO: 37380 - DNA, 24 bp, Homo sapiens
tgaatgtgaaggtccagaaatgtc

SEQ ID NO: 37381 - DNA, 24 bp, Homo sapiens
gtgaatgtgaaggtccagaaatgt

SEQ ID NO: 37382 - DNA, 24 bp, Homo sapiens
agtgaatgtgaaggtccagaaatg

SEQ ID NO: 37383 - DNA, 24 bp, Homo sapiens
cacctaaaaaggtaagaaagatac

SEQ ID NO: 37384 - DNA, 24 bp, Homo sapiens
tcacctaaaaaggtaagaaagata

SEQ ID NO: 37385 - DNA, 24 bp, Homo sapiens
atcacctaaaaaggtaagaaagat

SEQ ID NO: 37386 - DNA, 24 bp, Homo sapiens
caatgatgtgctgaaggctctggc

SEQ ID NO: 37387 - DNA, 24 bp, Homo sapiens
gtggtggctgctgtaaaggggaaa

SEQ ID NO: 37388 - DNA, 23 bp, Homo sapiens
gtctacctggatggcggggtccg

SEQ ID NO: 37389 - DNA, 25 bp, Homo sapiens
tgaagagattgttggattggcagca

SEQ ID NO: 37390 - DNA, 23 bp, Homo sapiens
ccatcggagttcacctgggctgc

SEQ ID NO: 37391 - DNA, 23 bp, Homo sapiens
cctcattcctgccgctgccgtcc

SEQ ID NO: 37392 - DNA, 24 bp, Homo sapiens
ttaaggaaaagaagaactacagaa

SEQ ID NO: 37393 - DNA, 24 bp, Homo sapiens
tttaaggaaaagaagaactacaga

SEQ ID NO: 37394 - DNA, 24 bp, Homo sapiens
ttttaaggaaaagaagaactacag

SEQ ID NO: 37395 - DNA, 24 bp, Homo sapiens
cttttatcccgaatgcattaaatt

SEQ ID NO: 37396 - DNA, 24 bp, Homo sapiens
tcttttatcccgaatgcattaaat

SEQ ID NO: 37397 - DNA, 24 bp, Homo sapiens
gtcttttatcccgaatgcattaaa

SEQ ID NO: 37398 - DNA, 24 bp, Homo sapiens
tctggaatgcagtagaagtatagg

SEQ ID NO: 37399 - DNA, 24 bp, Homo sapiens
ttctggaatgcagtagaagtatag

SEQ ID NO: 37400 - DNA, 24 bp, Homo sapiens
tttctggaatgcagtagaagtata

SEQ ID NO: 37401 - DNA, 25 bp, Homo sapiens
agagacagggtttcatcatgttggc

SEQ ID NO: 37402 - DNA, 25 bp, Homo sapiens
gtctcgaacttcggacttcgtggtc

SEQ ID NO: 37403 - DNA, 25 bp, Homo sapiens
caccgcgccaggctaattactgtat

SEQ ID NO: 37404 - DNA, 24 bp, Homo sapiens
tttaaacatagaacctagaagaga

SEQ ID NO: 37405 - DNA, 24 bp, Homo sapiens
ttttaaacatagaacctagaagag

SEQ ID NO: 37406 - DNA, 24 bp, Homo sapiens
tttttaaacatagaacctagaaga

SEQ ID NO: 37407 - DNA, 23 bp, Homo sapiens
ttggctcacgctgtggagttgtt

SEQ ID NO: 37408 - DNA, 25 bp, Homo sapiens
agaggtaactgacgatgagatggca

SEQ ID NO: 37409 - DNA, 25 bp, Homo sapiens
cggagtggttctgatcctcaagaca

SEQ ID NO: 37410 - DNA, 23 bp, Homo sapiens
ggaccgccttgccctctctttaa

SEQ ID NO: 37411 - DNA, 23 bp, Homo sapiens
gcagcaggcaggcaagcagcgtt

SEQ ID NO: 37412 - DNA, 25 bp, Homo sapiens
agagtacaaggagcgaatagcagcc

SEQ ID NO: 37413 - DNA, 24 bp, Homo sapiens
gaagaaatgtgatttcagaattaa

SEQ ID NO: 37414 - DNA, 24 bp, Homo sapiens
ggaagaaatgtgatttcagaatta

SEQ ID NO: 37415 - DNA, 24 bp, Homo sapiens
aggaagaaatgtgatttcagaatt

SEQ ID NO: 37416 - DNA, 24 bp, Homo sapiens
agacaatgaagatgatgaaatgca

SEQ ID NO: 37417 - DNA, 24 bp, Homo sapiens
tagacaatgaagatgatgaaatgc

SEQ ID NO: 37418 - DNA, 24 bp, Homo sapiens
ttagacaatgaagatgatgaaatg

SEQ ID NO: 37419 - DNA, 24 bp, Homo sapiens
atgagaatcaggatgaaagtcaaa

SEQ ID NO: 37420 - DNA, 24 bp, Homo sapiens
aatgagaatcaggatgaaagtcaa

SEQ ID NO: 37421 - DNA, 24 bp, Homo sapiens
aaatgagaatcaggatgaaagtca

SEQ ID NO: 37422 - DNA, 25 bp, Homo sapiens
caagtttaatgttcctcgtcgggca

SEQ ID NO: 37423 - DNA, 25 bp, Homo sapiens
ggctcctgttccttcaagagtgctg

SEQ ID NO: 37424 - DNA, 23 bp, Homo sapiens
gagccgctgccgccagggaactc

SEQ ID NO: 37425 - DNA, 24 bp, Homo sapiens
gaagtcttcttgcagccgtgtgga

SEQ ID NO: 37426 - DNA, 23 bp, Homo sapiens
gggagaggacaaagccacgcctt

SEQ ID NO: 37427 - DNA, 24 bp, Homo sapiens
agaggagtgaccacagaggcagag

SEQ ID NO: 37428 - DNA, 23 bp, Homo sapiens
ccttcatcgtccgccttccgttg

SEQ ID NO: 37429 - DNA, 23 bp, Homo sapiens
ctcagcctcagcctcagcctcca

SEQ ID NO: 37430 - DNA, 23 bp, Homo sapiens
cctccttcgatcatgcgtgtccg

SEQ ID NO: 37431 - DNA, 24 bp, Homo sapiens
gagacagcagcagcagcatccttc

SEQ ID NO: 37432 - DNA, 24 bp, Homo sapiens
gcagccttcggacttcaagacaga

SEQ ID NO: 37433 - DNA, 24 bp, Homo sapiens
aggctccagacagtcaccagaaga

SEQ ID NO: 37434 - DNA, 25 bp, Homo sapiens
cccagtgtttactcccatcaaggca

SEQ ID NO: 37435 - DNA, 23 bp, Homo sapiens
tgtcccacctgccgcccttcttc

SEQ ID NO: 37436 - DNA, 23 bp, Homo sapiens
ccgaacacttgctgaagccgctg

SEQ ID NO: 37437 - DNA, 24 bp, Homo sapiens
caaaaacagaagtttgttgataag

SEQ ID NO: 37438 - DNA, 24 bp, Homo sapiens
gcaaaaacagaagtttgttgataa

SEQ ID NO: 37439 - DNA, 24 bp, Homo sapiens
agcaaaaacagaagtttgttgata

SEQ ID NO: 37440 - DNA, 23 bp, Homo sapiens
gtcactgccactgctgctgctgc

SEQ ID NO: 37441 - DNA, 23 bp, Homo sapiens
gctcacctgcgctgtgatgcctg

SEQ ID NO: 37442 - DNA, 25 bp, Homo sapiens
ggatgatgaggagatgtactcagcc

SEQ ID NO: 37443 - DNA, 25 bp, Homo sapiens
ccacaactggatgatgaggagatgt

SEQ ID NO: 37444 - DNA, 23 bp, Homo sapiens
actgctgctgctgctgctgggag

SEQ ID NO: 37445 - DNA, 23 bp, Homo sapiens
gctcacctgcgctgtgatgcctg

SEQ ID NO: 37446 - DNA, 24 bp, Homo sapiens
cggcctcctcggtgagtgagggta

SEQ ID NO: 37447 - DNA, 24 bp, Homo sapiens
acggcctcctcggtgagtgagggt

SEQ ID NO: 37448 - DNA, 24 bp, Homo sapiens
cacggcctcctcggtgagtgaggg

SEQ ID NO: 37449 - DNA, 24 bp, Homo sapiens
caactaacaagaaaccaagtatct

SEQ ID NO: 37450 - DNA, 24 bp, Homo sapiens
acaactaacaagaaaccaagtatc

SEQ ID NO: 37451 - DNA, 24 bp, Homo sapiens
aacaactaacaagaaaccaagtat

SEQ ID NO: 37452 - DNA, 24 bp, Homo sapiens
gaccctggctggaggagcagccgc

SEQ ID NO: 37453 - DNA, 24 bp, Homo sapiens
agaccctggctggaggagcagccg

SEQ ID NO: 37454 - DNA, 24 bp, Homo sapiens
gagaccctggctggaggagcagcc

SEQ ID NO: 37455 - DNA, 24 bp, Homo sapiens
tggttttaaggtgagccatcttta

SEQ ID NO: 37456 - DNA, 24 bp, Homo sapiens
ctggttttaaggtgagccatcttt

SEQ ID NO: 37457 - DNA, 24 bp, Homo sapiens
gctggttttaaggtgagccatctt

SEQ ID NO: 37458 - DNA, 24 bp, Homo sapiens
aacaataccagagaaaaatctttg

SEQ ID NO: 37459 - DNA, 24 bp, Homo sapiens
aaacaataccagagaaaaatcttt

SEQ ID NO: 37460 - DNA, 24 bp, Homo sapiens
aaaacaataccagagaaaaatctt

SEQ ID NO: 37461 - DNA, 24 bp, Homo sapiens
ccaaacttcagatatcattgacaa

SEQ ID NO: 37462 - DNA, 24 bp, Homo sapiens
gccaaacttcagatatcattgaca

SEQ ID NO: 37463 - DNA, 24 bp, Homo sapiens
tgccaaacttcagatatcattgac

SEQ ID NO: 37464 - DNA, 24 bp, Homo sapiens
tcatattttagactgtgacaaaag

SEQ ID NO: 37465 - DNA, 24 bp, Homo sapiens
atcatattttagactgtgacaaaa

SEQ ID NO: 37466 - DNA, 24 bp, Homo sapiens
tatcatattttagactgtgacaaa

SEQ ID NO: 37467 - DNA, 24 bp, Homo sapiens
gattagaaaaagtatgcaattatt

SEQ ID NO: 37468 - DNA, 24 bp, Homo sapiens
ggattagaaaaagtatgcaattat

SEQ ID NO: 37469 - DNA, 24 bp, Homo sapiens
tggattagaaaaagtatgcaatta

SEQ ID NO: 37470 - DNA, 24 bp, Homo sapiens
ggaaaatgcaaattgtttttattt

SEQ ID NO: 37471 - DNA, 24 bp, Homo sapiens
tggaaaatgcaaattgtttttatt

SEQ ID NO: 37472 - DNA, 24 bp, Homo sapiens
ttggaaaatgcaaattgtttttat

SEQ ID NO: 37473 - DNA, 25 bp, Homo sapiens
agccactgtacccagccaaaattgt

SEQ ID NO: 37474 - DNA, 25 bp, Homo sapiens
taagtgaattcaacaatttctgtga

SEQ ID NO: 37475 - DNA, 25 bp, Homo sapiens
gccaccttagcaagcctcattaacc

SEQ ID NO: 37476 - DNA, 25 bp, Homo sapiens
ttgcgttagtattgttgttgttgtt

SEQ ID NO: 37477 - DNA, 23 bp, Homo sapiens
tcaagccatcctcccacctcagc

SEQ ID NO: 37478 - DNA, 24 bp, Homo sapiens
tttattgaaaaaggaaatagaaaa

SEQ ID NO: 37479 - DNA, 24 bp, Homo sapiens
atttattgaaaaaggaaatagaaa

SEQ ID NO: 37480 - DNA, 24 bp, Homo sapiens
gatttattgaaaaaggaaatagaa

SEQ ID NO: 37481 - DNA, 24 bp, Homo sapiens
tctcgtctccgttggccctgcatc

SEQ ID NO: 37482 - DNA, 24 bp, Homo sapiens
ctctcgtctccgttggccctgcat

SEQ ID NO: 37483 - DNA, 24 bp, Homo sapiens
gctctcgtctccgttggccctgca

SEQ ID NO: 37484 - DNA, 23 bp, Homo sapiens
ttgtgcttggtgctgctgatagg

SEQ ID NO: 37485 - DNA, 25 bp, Homo sapiens
gctctccaatactggtcaagacacc

SEQ ID NO: 37486 - DNA, 25 bp, Homo sapiens
gaacaatggaaatggcatggagaca

SEQ ID NO: 37487 - DNA, 24 bp, Homo sapiens
tggaggcattatggaacaggaggc

SEQ ID NO: 37488 - DNA, 25 bp, Homo sapiens
ggttgaagttgaaagaagcccgtgg

SEQ ID NO: 37489 - DNA, 25 bp, Homo sapiens
caggctggagtacaatggtgtgatt

SEQ ID NO: 37490 - DNA, 24 bp, Homo sapiens
ggctgcggctggcggctgcctgtg

SEQ ID NO: 37491 - DNA, 24 bp, Homo sapiens
aggctgcggctggcggctgcctgt

SEQ ID NO: 37492 - DNA, 24 bp, Homo sapiens
gaggctgcggctggcggctgcctg

SEQ ID NO: 37493 - DNA, 24 bp, Homo sapiens
aaacatagatgtaggtatttcgtg

SEQ ID NO: 37494 - DNA, 24 bp, Homo sapiens
gaaacatagatgtaggtatttcgt

SEQ ID NO: 37495 - DNA, 24 bp, Homo sapiens
agaaacatagatgtaggtatttcg

SEQ ID NO: 37496 - DNA, 25 bp, Homo sapiens
actctttctaatatgatgcggaagc

SEQ ID NO: 37497 - DNA, 24 bp, Homo sapiens
acttctcaaacattgctgcttaca

SEQ ID NO: 37498 - DNA, 24 bp, Homo sapiens
tatttgttattggtgtttacagaa

SEQ ID NO: 37499 - DNA, 24 bp, Homo sapiens
ctggagtggcagtggtcctgctcg

SEQ ID NO: 37500 - DNA, 24 bp, Homo sapiens
actggagtggcagtggtcctgctc

SEQ ID NO: 37501 - DNA, 24 bp, Homo sapiens
aactggagtggcagtggtcctgct

SEQ ID NO: 37502 - DNA, 24 bp, Homo sapiens
gtaaatggaaggttgcttttaact

SEQ ID NO: 37503 - DNA, 24 bp, Homo sapiens
agtaaatggaaggttgcttttaac

SEQ ID NO: 37504 - DNA, 24 bp, Homo sapiens
gagtaaatggaaggttgcttttaa

SEQ ID NO: 37505 - DNA, 23 bp, Homo sapiens
gaccaccagcctgtccacctgag

SEQ ID NO: 37506 - DNA, 24 bp, Homo sapiens
gaggacacctacagctccgaggag

SEQ ID NO: 37507 - DNA, 24 bp, Homo sapiens
gccctgaccgtgaagtttctgacc

SEQ ID NO: 37508 - DNA, 23 bp, Homo sapiens
gggcgacaaactgtcctgagccc

SEQ ID NO: 37509 - DNA, 23 bp, Homo sapiens
gccggaggacgcgcccatagaat

SEQ ID NO: 37510 - DNA, 23 bp, Homo sapiens
cgttcgcagccgccgtcatcccg

SEQ ID NO: 37511 - DNA, 24 bp, Homo sapiens
cctacagaagctacagatggagag

SEQ ID NO: 37512 - DNA, 23 bp, Homo sapiens
ctgcccaagccgctcagccgcat

SEQ ID NO: 37513 - DNA, 24 bp, Homo sapiens
tctctgcccatggatatccgcctg

SEQ ID NO: 37514 - DNA, 24 bp, Homo sapiens
cccgcaacctcctcaacttcccta

SEQ ID NO: 37515 - DNA, 24 bp, Homo sapiens
cgtgagttgcagcatgtgccgaag

SEQ ID NO: 37516 - DNA, 24 bp, Homo sapiens
cagaaatccgaccggaccgggctc

SEQ ID NO: 37517 - DNA, 24 bp, Homo sapiens
actatattcaagtaagttcactct

SEQ ID NO: 37518 - DNA, 24 bp, Homo sapiens
gactatattcaagtaagttcactc

SEQ ID NO: 37519 - DNA, 24 bp, Homo sapiens
tgactatattcaagtaagttcact

SEQ ID NO: 37520 - DNA, 24 bp, Homo sapiens
tctttccacagccactggcttcca

SEQ ID NO: 37521 - DNA, 24 bp, Homo sapiens
ttctttccacagccactggcttcc

SEQ ID NO: 37522 - DNA, 24 bp, Homo sapiens
cttctttccacagccactggcttc

SEQ ID NO: 37523 - DNA, 25 bp, Homo sapiens
cgagacgctcacggatatagtgctc

SEQ ID NO: 37524 - DNA, 23 bp, Homo sapiens
ccttcgtgatatggctgctgtcc

SEQ ID NO: 37525 - DNA, 23 bp, Homo sapiens
ccaagggctccagcgtgctctac

SEQ ID NO: 37526 - DNA, 23 bp, Homo sapiens
gacccagccctggcagcctcctg

SEQ ID NO: 37527 - DNA, 23 bp, Homo sapiens
ctgatccgggacgaggacgcact

SEQ ID NO: 37528 - DNA, 23 bp, Homo sapiens
ctccgcagcttcagcatgcagga

SEQ ID NO: 37529 - DNA, 24 bp, Homo sapiens
tatgatagaaggtgatttttgtaa

SEQ ID NO: 37530 - DNA, 24 bp, Homo sapiens
ttatgatagaaggtgatttttgta

SEQ ID NO: 37531 - DNA, 24 bp, Homo sapiens
cttatgatagaaggtgatttttgt

SEQ ID NO: 37532 - DNA, 25 bp, Homo sapiens
tcggtggaagaggtagagcagttga

SEQ ID NO: 37533 - DNA, 25 bp, Homo sapiens
ggtcttcctgaaggttctgactgcc

SEQ ID NO: 37534 - DNA, 23 bp, Homo sapiens
agagtgaaggagctggcggagag

SEQ ID NO: 37535 - DNA, 25 bp, Homo sapiens
ccaagaggattcaggagaaggaagc

SEQ ID NO: 37536 - DNA, 23 bp, Homo sapiens
agaggctgctgcggaaacacgag

SEQ ID NO: 37537 - DNA, 24 bp, Homo sapiens
ggtggagtccctagagcgtgaagt

SEQ ID NO: 37538 - DNA, 24 bp, Homo sapiens
gggtctttggagttcaagcagcac

SEQ ID NO: 37539 - DNA, 23 bp, Homo sapiens
ggatgagaggatggcagcggaga

SEQ ID NO: 37540 - DNA, 24 bp, Homo sapiens
tccatagccctccttgacctcacg

SEQ ID NO: 37541 - DNA, 23 bp, Homo sapiens
ggcagaggctggagcaggctgag

SEQ ID NO: 37542 - DNA, 23 bp, Homo sapiens
agccacttcatgtctgcggaggt

SEQ ID NO: 37543 - DNA, 24 bp, Homo sapiens
caagaaatcagggagtgccgcctt

SEQ ID NO: 37544 - DNA, 24 bp, Homo sapiens
caatgttgaatgtactgaagattt

SEQ ID NO: 37545 - DNA, 24 bp, Homo sapiens
acaatgttgaatgtactgaagatt

SEQ ID NO: 37546 - DNA, 24 bp, Homo sapiens
cacaatgttgaatgtactgaagat

SEQ ID NO: 37547 - DNA, 24 bp, Homo sapiens
ttttatttcaggacaatgaaatca

SEQ ID NO: 37548 - DNA, 24 bp, Homo sapiens
attttatttcaggacaatgaaatc

SEQ ID NO: 37549 - DNA, 24 bp, Homo sapiens
gattttatttcaggacaatgaaat

SEQ ID NO: 37550 - DNA, 24 bp, Homo sapiens
attttgtgcaggtatctggcataa

SEQ ID NO: 37551 - DNA, 24 bp, Homo sapiens
tattttgtgcaggtatctggcata

SEQ ID NO: 37552 - DNA, 24 bp, Homo sapiens
atattttgtgcaggtatctggcat

SEQ ID NO: 37553 - DNA, 24 bp, Homo sapiens
gtggaatatagggaggtgtttatt

SEQ ID NO: 37554 - DNA, 24 bp, Homo sapiens
agtggaatatagggaggtgtttat

SEQ ID NO: 37555 - DNA, 24 bp, Homo sapiens
cagtggaatatagggaggtgttta

SEQ ID NO: 37556 - DNA, 24 bp, Homo sapiens
tgaatttacaggaaaatggctagc

SEQ ID NO: 37557 - DNA, 24 bp, Homo sapiens
ttgaatttacaggaaaatggctag

SEQ ID NO: 37558 - DNA, 24 bp, Homo sapiens
attgaatttacaggaaaatggcta

SEQ ID NO: 37559 - DNA, 24 bp, Homo sapiens
aattttcttaggaagagcaaaaag

SEQ ID NO: 37560 - DNA, 24 bp, Homo sapiens
taattttcttaggaagagcaaaaa

SEQ ID NO: 37561 - DNA, 24 bp, Homo sapiens
ttaattttcttaggaagagcaaaa

SEQ ID NO: 37562 - DNA, 23 bp, Homo sapiens
caccgcaaactgaccctgctggt

SEQ ID NO: 37563 - DNA, 23 bp, Homo sapiens
gacactgtcttggacttggtaga

SEQ ID NO: 37564 - DNA, 23 bp, Homo sapiens
gagtggctgtggtggcccccctg

SEQ ID NO: 37565 - DNA, 24 bp, Homo sapiens
aatttaaacaggtaagagttttaa

SEQ ID NO: 37566 - DNA, 24 bp, Homo sapiens
taatttaaacaggtaagagtttta

SEQ ID NO: 37567 - DNA, 24 bp, Homo sapiens
ataatttaaacaggtaagagtttt

SEQ ID NO: 37568 - DNA, 24 bp, Homo sapiens
attttttaaagcttttagatactc

SEQ ID NO: 37569 - DNA, 24 bp, Homo sapiens
aattttttaaagcttttagatact

SEQ ID NO: 37570 - DNA, 24 bp, Homo sapiens
taattttttaaagcttttagatac

SEQ ID NO: 37571 - DNA, 23 bp, Homo sapiens
ccgaccctgcccagccagatatg

SEQ ID NO: 37572 - DNA, 24 bp, Homo sapiens
cctgcggttctgatttcgtccctg

SEQ ID NO: 37573 - DNA, 24 bp, Homo sapiens
acagaagcaagtttgaggtcgggc

SEQ ID NO: 37574 - DNA, 24 bp, Homo sapiens
ggaagaaagggaatattttgatga

SEQ ID NO: 37575 - DNA, 24 bp, Homo sapiens
aggaagaaagggaatattttgatg

SEQ ID NO: 37576 - DNA, 24 bp, Homo sapiens
aaggaagaaagggaatattttgat

SEQ ID NO: 37577 - DNA, 24 bp, Homo sapiens
tagtagaaaaggcaaaagaaaaac

SEQ ID NO: 37578 - DNA, 24 bp, Homo sapiens
ctagtagaaaaggcaaaagaaaaa

SEQ ID NO: 37579 - DNA, 24 bp, Homo sapiens
actagtagaaaaggcaaaagaaaa

SEQ ID NO: 37580 - DNA, 24 bp, Homo sapiens
ctccttcacaggtgactcccgcgg

SEQ ID NO: 37581 - DNA, 24 bp, Homo sapiens
actccttcacaggtgactcccgcg

SEQ ID NO: 37582 - DNA, 24 bp, Homo sapiens
gactccttcacaggtgactcccgc

SEQ ID NO: 37583 - DNA, 24 bp, Homo sapiens
tgaatctccaaaaaagaagacttt

SEQ ID NO: 37584 - DNA, 24 bp, Homo sapiens
atgaatctccaaaaaagaagactt

SEQ ID NO: 37585 - DNA, 24 bp, Homo sapiens
aatgaatctccaaaaaagaagact

SEQ ID NO: 37586 - DNA, 24 bp, Homo sapiens
ttcttagtcagatcataacagaat

SEQ ID NO: 37587 - DNA, 24 bp, Homo sapiens
attcttagtcagatcataacagaa

SEQ ID NO: 37588 - DNA, 24 bp, Homo sapiens
tattcttagtcagatcataacaga

SEQ ID NO: 37589 - DNA, 24 bp, Homo sapiens
ggaagctgcagaaagccatctctg

SEQ ID NO: 37590 - DNA, 24 bp, Homo sapiens
tggaagctgcagaaagccatctct

SEQ ID NO: 37591 - DNA, 24 bp, Homo sapiens
ctggaagctgcagaaagccatctc

SEQ ID NO: 37592 - DNA, 24 bp, Homo sapiens
attttgtttagcatgaagaaagca

SEQ ID NO: 37593 - DNA, 24 bp, Homo sapiens
aattttgtttagcatgaagaaagc

SEQ ID NO: 37594 - DNA, 24 bp, Homo sapiens
taattttgtttagcatgaagaaag

SEQ ID NO: 37595 - DNA, 24 bp, Homo sapiens
ggactgtcaagcagcagcaggcgc

SEQ ID NO: 37596 - DNA, 24 bp, Homo sapiens
gggactgtcaagcagcagcaggcg

SEQ ID NO: 37597 - DNA, 24 bp, Homo sapiens
agggactgtcaagcagcagcaggc

SEQ ID NO: 37598 - DNA, 24 bp, Homo sapiens
tggctgatgataatgttaaagatt

SEQ ID NO: 37599 - DNA, 24 bp, Homo sapiens
atggctgatgataatgttaaagat

SEQ ID NO: 37600 - DNA, 24 bp, Homo sapiens
gatggctgatgataatgttaaaga

SEQ ID NO: 37601 - DNA, 24 bp, Homo sapiens
tttataaacagttcaaaagaatgc

SEQ ID NO: 37602 - DNA, 24 bp, Homo sapiens
ctttataaacagttcaaaagaatg

SEQ ID NO: 37603 - DNA, 24 bp, Homo sapiens
tctttataaacagttcaaaagaat

SEQ ID NO: 37604 - DNA, 24 bp, Homo sapiens
ttgatgtaattgtaagtattttaa

SEQ ID NO: 37605 - DNA, 24 bp, Homo sapiens
tttgatgtaattgtaagtatttta

SEQ ID NO: 37606 - DNA, 24 bp, Homo sapiens
atttgatgtaattgtaagtatttt

SEQ ID NO: 37607 - DNA, 24 bp, Homo sapiens
ttttctttcagtctacttcaaatt

SEQ ID NO: 37608 - DNA, 24 bp, Homo sapiens
attttctttcagtctacttcaaat

SEQ ID NO: 37609 - DNA, 24 bp, Homo sapiens
aattttctttcagtctacttcaaa

SEQ ID NO: 37610 - DNA, 24 bp, Homo sapiens
ccccttaacaaatttcctggattt

SEQ ID NO: 37611 - DNA, 24 bp, Homo sapiens
tccccttaacaaatttcctggatt

SEQ ID NO: 37612 - DNA, 24 bp, Homo sapiens
ttccccttaacaaatttcctggat

SEQ ID NO: 37613 - DNA, 24 bp, Homo sapiens
ggagcagccaaccccgcccctgca

SEQ ID NO: 37614 - DNA, 24 bp, Homo sapiens
aggagcagccaaccccgcccctgc

SEQ ID NO: 37615 - DNA, 24 bp, Homo sapiens
taggagcagccaaccccgcccctg

SEQ ID NO: 37616 - DNA, 24 bp, Homo sapiens
cagaggagcaggatcagcggcaaa

SEQ ID NO: 37617 - DNA, 24 bp, Homo sapiens
gcagaggagcaggatcagcggcaa

SEQ ID NO: 37618 - DNA, 24 bp, Homo sapiens
agcagaggagcaggatcagcggca

SEQ ID NO: 37619 - DNA, 25 bp, Homo sapiens
ttaattgaagagtcttgtccacagc

SEQ ID NO: 37620 - DNA, 23 bp, Homo sapiens
gtgctggtgctgctgaacgagat

SEQ ID NO: 37621 - DNA, 25 bp, Homo sapiens
ccaatgtgttcggcatcaaggactg

SEQ ID NO: 37622 - DNA, 24 bp, Homo sapiens
tagttcctgtggtaagtacatacg

SEQ ID NO: 37623 - DNA, 24 bp, Homo sapiens
atagttcctgtggtaagtacatac

SEQ ID NO: 37624 - DNA, 24 bp, Homo sapiens
gatagttcctgtggtaagtacata

SEQ ID NO: 37625 - DNA, 23 bp, Homo sapiens
ctggggttgtggctgttgctgtg

SEQ ID NO: 37626 - DNA, 23 bp, Homo sapiens
gcgtcgtcgcggagctcgtctcc

SEQ ID NO: 37627 - DNA, 23 bp, Homo sapiens
ccccgagggcgccgagctgcgtg

SEQ ID NO: 37628 - DNA, 24 bp, Homo sapiens
tacatccaagtcctgctgcatcca

SEQ ID NO: 37629 - DNA, 24 bp, Homo sapiens
gatgactcaagccagtggaagacc

SEQ ID NO: 37630 - DNA, 24 bp, Homo sapiens
gccacattggaagaattgtcttgg

SEQ ID NO: 37631 - DNA, 24 bp, Homo sapiens
tttttccccaggatgaagatcttc

SEQ ID NO: 37632 - DNA, 24 bp, Homo sapiens
gtttttccccaggatgaagatctt

SEQ ID NO: 37633 - DNA, 24 bp, Homo sapiens
tgtttttccccaggatgaagatct

SEQ ID NO: 37634 - DNA, 24 bp, Homo sapiens
aaacccagttaaaaaatatttgtt

SEQ ID NO: 37635 - DNA, 24 bp, Homo sapiens
aaaacccagttaaaaaatatttgt

SEQ ID NO: 37636 - DNA, 24 bp, Homo sapiens
aaaaacccagttaaaaaatatttg

SEQ ID NO: 37637 - DNA, 24 bp, Homo sapiens
tcgccctccactgacatctttgat

SEQ ID NO: 37638 - DNA, 25 bp, Homo sapiens
ttctccaatatcacaccagtcttcg

SEQ ID NO: 37639 - DNA, 24 bp, Homo sapiens
gcacacagccacctccagtaccta

SEQ ID NO: 37640 - DNA, 24 bp, Homo sapiens
tgtgttgatagctacactcataac

SEQ ID NO: 37641 - DNA, 24 bp, Homo sapiens
ctgtgttgatagctacactcataa

SEQ ID NO: 37642 - DNA, 24 bp, Homo sapiens
tctgtgttgatagctacactcata

SEQ ID NO: 37643 - DNA, 24 bp, Homo sapiens
cagttgttaaggtttttgatgaga

SEQ ID NO: 37644 - DNA, 24 bp, Homo sapiens
acagttgttaaggtttttgatgag

SEQ ID NO: 37645 - DNA, 24 bp, Homo sapiens
tacagttgttaaggtttttgatga

SEQ ID NO: 37646 - DNA, 23 bp, Homo sapiens
ccttttcttgttcctactgtaaa

SEQ ID NO: 37647 - DNA, 25 bp, Homo sapiens
tttgcatttccttcaccaatgtcgt

SEQ ID NO: 37648 - DNA, 25 bp, Homo sapiens
aaatattctccactgaagcaaatgc

SEQ ID NO: 37649 - DNA, 24 bp, Homo sapiens
gatgacttgcgtcctgagaaccac

SEQ ID NO: 37650 - DNA, 23 bp, Homo sapiens
ccgacagtcctggcatcttccct

SEQ ID NO: 37651 - DNA, 25 bp, Homo sapiens
ggactttgactgggctgactacctc

SEQ ID NO: 37652 - DNA, 24 bp, Homo sapiens
ttacctcccagatactattttttg

SEQ ID NO: 37653 - DNA, 24 bp, Homo sapiens
attacctcccagatactatttttt

SEQ ID NO: 37654 - DNA, 24 bp, Homo sapiens
gattacctcccagatactattttt

SEQ ID NO: 37655 - DNA, 23 bp, Homo sapiens
ctccatgtcaggactggccgctg

SEQ ID NO: 37656 - DNA, 23 bp, Homo sapiens
ccccagtcccacctccacccact

SEQ ID NO: 37657 - DNA, 23 bp, Homo sapiens
ccgtctcatgtagtgggcctcca

SEQ ID NO: 37658 - DNA, 24 bp, Homo sapiens
ctcccacctcagcctcccaagtag

SEQ ID NO: 37659 - DNA, 25 bp, Homo sapiens
cgctaaagcctcaaccttggactca

SEQ ID NO: 37660 - DNA, 23 bp, Homo sapiens
ggctgcagtgcagtggtgtgatc

SEQ ID NO: 37661 - DNA, 23 bp, Homo sapiens
ttatttcccctaggcagccagtg

SEQ ID NO: 37662 - DNA, 23 bp, Homo sapiens
gttcaaatgctcagctgttctgg

SEQ ID NO: 37663 - DNA, 23 bp, Homo sapiens
ctcggtgctcaacagcctggtgg

SEQ ID NO: 37664 - DNA, 23 bp, Homo sapiens
cctgcatcttcctgcggcccagc

SEQ ID NO: 37665 - DNA, 23 bp, Homo sapiens
ccagccccagctccagccccaag

SEQ ID NO: 37666 - DNA, 24 bp, Homo sapiens
ctcttttcaaggtaattttcgttt

SEQ ID NO: 37667 - DNA, 24 bp, Homo sapiens
cctcttttcaaggtaattttcgtt

SEQ ID NO: 37668 - DNA, 24 bp, Homo sapiens
gcctcttttcaaggtaattttcgt

SEQ ID NO: 37669 - DNA, 24 bp, Homo sapiens
attttatcctgattcgggaactgg

SEQ ID NO: 37670 - DNA, 24 bp, Homo sapiens
cattttatcctgattcgggaactg

SEQ ID NO: 37671 - DNA, 24 bp, Homo sapiens
ccattttatcctgattcgggaact

SEQ ID NO: 37672 - DNA, 24 bp, Homo sapiens
ggtgtgaaaggatatcacagtgat

SEQ ID NO: 37673 - DNA, 24 bp, Homo sapiens
aggtgtgaaaggatatcacagtga

SEQ ID NO: 37674 - DNA, 24 bp, Homo sapiens
aaggtgtgaaaggatatcacagtg

SEQ ID NO: 37675 - DNA, 24 bp, Homo sapiens
ttgattaccaactcactggacagc

SEQ ID NO: 37676 - DNA, 24 bp, Homo sapiens
gttgattaccaactcactggacag

SEQ ID NO: 37677 - DNA, 24 bp, Homo sapiens
tgttgattaccaactcactggaca

SEQ ID NO: 37678 - DNA, 24 bp, Homo sapiens
ctctcctgaaactcttacaaactt

SEQ ID NO: 37679 - DNA, 24 bp, Homo sapiens
gctctcctgaaactcttacaaact

SEQ ID NO: 37680 - DNA, 24 bp, Homo sapiens
ggctctcctgaaactcttacaaac

SEQ ID NO: 37681 - DNA, 23 bp, Homo sapiens
ctcagccgccgaggagccatcag

SEQ ID NO: 37682 - DNA, 25 bp, Homo sapiens
tctctcagaggcgtggagctatttc

SEQ ID NO: 37683 - DNA, 23 bp, Homo sapiens
cgtgtaaggagccgagcaggatt

SEQ ID NO: 37684 - DNA, 24 bp, Homo sapiens
tactattgcagactttataacaaa

SEQ ID NO: 37685 - DNA, 24 bp, Homo sapiens
ttactattgcagactttataacaa

SEQ ID NO: 37686 - DNA, 24 bp, Homo sapiens
cttactattgcagactttataaca

SEQ ID NO: 37687 - DNA, 24 bp, Homo sapiens
gtagtacgcagggtggatagagaa

SEQ ID NO: 37688 - DNA, 24 bp, Homo sapiens
tgtagtacgcagggtggatagaga

SEQ ID NO: 37689 - DNA, 24 bp, Homo sapiens
gtgtagtacgcagggtggatagag

SEQ ID NO: 37690 - DNA, 24 bp, Homo sapiens
gaaatcacaagaaccgggtgaaca

SEQ ID NO: 37691 - DNA, 24 bp, Homo sapiens
ggaaatcacaagaaccgggtgaac

SEQ ID NO: 37692 - DNA, 24 bp, Homo sapiens
gggaaatcacaagaaccgggtgaa

SEQ ID NO: 37693 - DNA, 25 bp, Homo sapiens
tggctctcattgacatcactgtgcg

SEQ ID NO: 37694 - DNA, 23 bp, Homo sapiens
atgagccacagccaccacactct

SEQ ID NO: 37695 - DNA, 23 bp, Homo sapiens
cctgcttctggctctcaacctgc

SEQ ID NO: 37696 - DNA, 24 bp, Homo sapiens
gcagtctccaggagaagttctcac

SEQ ID NO: 37697 - DNA, 24 bp, Homo sapiens
tgcagtctccaggagaagttctca

SEQ ID NO: 37698 - DNA, 24 bp, Homo sapiens
ctgcagtctccaggagaagttctc

SEQ ID NO: 37699 - DNA, 25 bp, Homo sapiens
tcacttggctgtcctagagaaacgc

SEQ ID NO: 37700 - DNA, 23 bp, Homo sapiens
gccagaagcagcaggaccaactg

SEQ ID NO: 37701 - DNA, 25 bp, Homo sapiens
ataaccacaagaagttgactcctcg

SEQ ID NO: 37702 - DNA, 25 bp, Homo sapiens
gcagagcagttctcaagagcattca

SEQ ID NO: 37703 - DNA, 23 bp, Homo sapiens
gccagaagcagcaggaccaactg

SEQ ID NO: 37704 - DNA, 25 bp, Homo sapiens
ataaccacaagaagttgactcctcg

SEQ ID NO: 37705 - DNA, 23 bp, Homo sapiens
ggacacctgaccatgtgcctgcc

SEQ ID NO: 37706 - DNA, 23 bp, Homo sapiens
catctctgttgtgggcagcaggg

SEQ ID NO: 37707 - DNA, 23 bp, Homo sapiens
gcagtagcagcagcagcaccaat

SEQ ID NO: 37708 - DNA, 24 bp, Homo sapiens
ttttagaagaggaaagactaatat

SEQ ID NO: 37709 - DNA, 24 bp, Homo sapiens
gttttagaagaggaaagactaata

SEQ ID NO: 37710 - DNA, 24 bp, Homo sapiens
agttttagaagaggaaagactaat

SEQ ID NO: 37711 - DNA, 23 bp, Homo sapiens
cggatcaacggctctatccccgc

SEQ ID NO: 37712 - DNA, 23 bp, Homo sapiens
ctcagagcccgccagccccaaac

SEQ ID NO: 37713 - DNA, 23 bp, Homo sapiens
caccagccctgccccccacagac

SEQ ID NO: 37714 - DNA, 25 bp, Homo sapiens
ggcatggtggatcacaaggtcaaga

SEQ ID NO: 37715 - DNA, 25 bp, Homo sapiens
aacacatccatctgctttcctcctg

SEQ ID NO: 37716 - DNA, 25 bp, Homo sapiens
ggtactccctttaagatgtgtccct

SEQ ID NO: 37717 - DNA, 24 bp, Homo sapiens
taccctatcagcaaagactcttgg

SEQ ID NO: 37718 - DNA, 24 bp, Homo sapiens
ataccctatcagcaaagactcttg

SEQ ID NO: 37719 - DNA, 24 bp, Homo sapiens
tataccctatcagcaaagactctt

SEQ ID NO: 37720 - DNA, 24 bp, Homo sapiens
gtgacggtcttggaagtgagcagt

SEQ ID NO: 37721 - DNA, 24 bp, Homo sapiens
agaatgagcttgaaggcaggcaca

SEQ ID NO: 37722 - DNA, 24 bp, Homo sapiens
agagtgaagtgagctggcagtacc

SEQ ID NO: 37723 - DNA, 24 bp, Homo sapiens
gactggtcttgaactcctgggctc

SEQ ID NO: 37724 - DNA, 24 bp, Homo sapiens
ggcgttcctggtcttaggctgtct

SEQ ID NO: 37725 - DNA, 24 bp, Homo sapiens
gtgacggtcttggaagtgagcagt

SEQ ID NO: 37726 - DNA, 24 bp, Homo sapiens
agaatgagcttgaaggcaggcaca

SEQ ID NO: 37727 - DNA, 24 bp, Homo sapiens
ttgtaatcaagtttctagagttgt

SEQ ID NO: 37728 - DNA, 24 bp, Homo sapiens
attgtaatcaagtttctagagttg

SEQ ID NO: 37729 - DNA, 24 bp, Homo sapiens
gattgtaatcaagtttctagagtt

SEQ ID NO: 37730 - DNA, 23 bp, Homo sapiens
caacccgctcagccgcctcaaac

SEQ ID NO: 37731 - DNA, 23 bp, Homo sapiens
cctccctggaagagctgcagtcg

SEQ ID NO: 37732 - DNA, 23 bp, Homo sapiens
tctgagcggcacgtgctcctcta

SEQ ID NO: 37733 - DNA, 24 bp, Homo sapiens
tattaccaatggtaagaattcact

SEQ ID NO: 37734 - DNA, 24 bp, Homo sapiens
ttattaccaatggtaagaattcac

SEQ ID NO: 37735 - DNA, 24 bp, Homo sapiens
attattaccaatggtaagaattca

SEQ ID NO: 37736 - DNA, 24 bp, Homo sapiens
tattaccaatggaaatgtttttct

SEQ ID NO: 37737 - DNA, 24 bp, Homo sapiens
ttattaccaatggaaatgtttttc

SEQ ID NO: 37738 - DNA, 24 bp, Homo sapiens
attattaccaatggaaatgttttt

SEQ ID NO: 37739 - DNA, 24 bp, Homo sapiens
actctggggaggtttgctggcatg

SEQ ID NO: 37740 - DNA, 24 bp, Homo sapiens
cactctggggaggtttgctggcat

SEQ ID NO: 37741 - DNA, 24 bp, Homo sapiens
tcactctggggaggtttgctggca

SEQ ID NO: 37742 - DNA, 25 bp, Homo sapiens
agttgaaggactggaacaagtgaac

SEQ ID NO: 37743 - DNA, 23 bp, Homo sapiens
cgagcggagggtaattcatttgc

SEQ ID NO: 37744 - DNA, 23 bp, Homo sapiens
caggtgttgaggggctcccggtc

SEQ ID NO: 37745 - DNA, 25 bp, Homo sapiens
agcgattctcatacctcagcctcct

SEQ ID NO: 37746 - DNA, 23 bp, Homo sapiens
tggagtacagcggcgtgatctcg

SEQ ID NO: 37747 - DNA, 23 bp, Homo sapiens
gccgccagagtgtcactttgtca

SEQ ID NO: 37748 - DNA, 24 bp, Homo sapiens
acaatgtaccgaataaaaatttac

SEQ ID NO: 37749 - DNA, 24 bp, Homo sapiens
aacaatgtaccgaataaaaattta

SEQ ID NO: 37750 - DNA, 24 bp, Homo sapiens
taacaatgtaccgaataaaaattt

SEQ ID NO: 37751 - DNA, 25 bp, Homo sapiens
gcctgtttacccagcactttacaag

SEQ ID NO: 37752 - DNA, 25 bp, Homo sapiens
caaacttgtccatcatattgaccgc

SEQ ID NO: 37753 - DNA, 23 bp, Homo sapiens
gggaggatcacttgagcccaggg

SEQ ID NO: 37754 - DNA, 24 bp, Homo sapiens
aaaatccataggttaatcatgtta

SEQ ID NO: 37755 - DNA, 24 bp, Homo sapiens
taaaatccataggttaatcatgtt

SEQ ID NO: 37756 - DNA, 24 bp, Homo sapiens
ttaaaatccataggttaatcatgt

SEQ ID NO: 37757 - DNA, 24 bp, Homo sapiens
taaataaatcggtaagttttaata

SEQ ID NO: 37758 - DNA, 24 bp, Homo sapiens
ttaaataaatcggtaagttttaat

SEQ ID NO: 37759 - DNA, 24 bp, Homo sapiens
tttaaataaatcggtaagttttaa

SEQ ID NO: 37760 - DNA, 23 bp, Homo sapiens
agcagcagcagcaacagcagcag

SEQ ID NO: 37761 - DNA, 23 bp, Homo sapiens
agcagcaacagcagcagttccag

SEQ ID NO: 37762 - DNA, 23 bp, Homo sapiens
agcagcagcaggcggcgctacag

SEQ ID NO: 37763 - DNA, 23 bp, Homo sapiens
cctcctgggctcaagcgatcctc

SEQ ID NO: 37764 - DNA, 24 bp, Homo sapiens
tgaagtgcagtggcgtgattgtgg

SEQ ID NO: 37765 - DNA, 24 bp, Homo sapiens
atcagcaacagcagcagctgcagc

SEQ ID NO: 37766 - DNA, 24 bp, Homo sapiens
aatcagcaacagcagcagctgcag

SEQ ID NO: 37767 - DNA, 24 bp, Homo sapiens
aaatcagcaacagcagcagctgca

SEQ ID NO: 37768 - DNA, 24 bp, Homo sapiens
taccttgtaaggtaaaaatgtgct

SEQ ID NO: 37769 - DNA, 24 bp, Homo sapiens
ttaccttgtaaggtaaaaatgtgc

SEQ ID NO: 37770 - DNA, 24 bp, Homo sapiens
gttaccttgtaaggtaaaaatgtg

SEQ ID NO: 37771 - DNA, 24 bp, Homo sapiens
taagtttggagattgaaagtgaag

SEQ ID NO: 37772 - DNA, 24 bp, Homo sapiens
ttaagtttggagattgaaagtgaa

SEQ ID NO: 37773 - DNA, 24 bp, Homo sapiens
tttaagtttggagattgaaagtga

SEQ ID NO: 37774 - DNA, 24 bp, Homo sapiens
ctgggctgagagtggatggaatgg

SEQ ID NO: 37775 - DNA, 24 bp, Homo sapiens
cctgggctgagagtggatggaatg

SEQ ID NO: 37776 - DNA, 24 bp, Homo sapiens
tcctgggctgagagtggatggaat

SEQ ID NO: 37777 - DNA, 23 bp, Homo sapiens
atctcggcccactgaaacctcca

SEQ ID NO: 37778 - DNA, 23 bp, Homo sapiens
ggaagccgcagactgaatctcgc

SEQ ID NO: 37779 - DNA, 24 bp, Homo sapiens
gtatgacgcacttttccagctcga

SEQ ID NO: 37780 - DNA, 24 bp, Homo sapiens
cttcaagtgatagttcgcagtatg

SEQ ID NO: 37781 - DNA, 24 bp, Homo sapiens
tcttcaagtgatagttcgcagtat

SEQ ID NO: 37782 - DNA, 24 bp, Homo sapiens
ctcttcaagtgatagttcgcagta

SEQ ID NO: 37783 - DNA, 23 bp, Homo sapiens
ctggagaaggcggaagtggaggt

SEQ ID NO: 37784 - DNA, 25 bp, Homo sapiens
cctttgtgtccagagccctgaagtg

SEQ ID NO: 37785 - DNA, 25 bp, Homo sapiens
tgccaacatgctggtggagtattcc

SEQ ID NO: 37786 - DNA, 25 bp, Homo sapiens
gcctccctggatgcttactactcct

SEQ ID NO: 37787 - DNA, 23 bp, Homo sapiens
agccgcttctacacagtcatcag

SEQ ID NO: 37788 - DNA, 23 bp, Homo sapiens
atgagcccaagccgcccaagacc

SEQ ID NO: 37789 - DNA, 23 bp, Homo sapiens
gtgcagcttggtggcggctgagc

SEQ ID NO: 37790 - DNA, 23 bp, Homo sapiens
cccggcagcggggtaggatggcg

SEQ ID NO: 37791 - DNA, 23 bp, Homo sapiens
cgggccgcctcaggcagccccgg

SEQ ID NO: 37792 - DNA, 24 bp, Homo sapiens
tcttccatcgggtaagtattttga

SEQ ID NO: 37793 - DNA, 24 bp, Homo sapiens
ttcttccatcgggtaagtattttg

SEQ ID NO: 37794 - DNA, 24 bp, Homo sapiens
attcttccatcgggtaagtatttt

SEQ ID NO: 37795 - DNA, 23 bp, Homo sapiens
acttggtcctgatgcgttctggc

SEQ ID NO: 37796 - DNA, 25 bp, Homo sapiens
accaccacggaaattacggcttgtc

SEQ ID NO: 37797 - DNA, 24 bp, Homo sapiens
aggctggaatgcaatggctcactg

SEQ ID NO: 37798 - DNA, 24 bp, Homo sapiens
catcattaatggtttgtacatttc

SEQ ID NO: 37799 - DNA, 24 bp, Homo sapiens
gcatcattaatggtttgtacattt

SEQ ID NO: 37800 - DNA, 24 bp, Homo sapiens
agcatcattaatggtttgtacatt

SEQ ID NO: 37801 - DNA, 24 bp, Homo sapiens
tgaggcaggagaatggcttgaacc

SEQ ID NO: 37802 - DNA, 25 bp, Homo sapiens
agcctggacaatagagactcctcct

SEQ ID NO: 37803 - DNA, 25 bp, Homo sapiens
gaattacagacatgagccaccatcc

SEQ ID NO: 37804 - DNA, 24 bp, Homo sapiens
atgtttttcagtttaccagtaaat

SEQ ID NO: 37805 - DNA, 24 bp, Homo sapiens
gatgtttttcagtttaccagtaaa

SEQ ID NO: 37806 - DNA, 24 bp, Homo sapiens
tgatgtttttcagtttaccagtaa

SEQ ID NO: 37807 - DNA, 24 bp, Homo sapiens
tctttgaaaagctgaaaaatacaa

SEQ ID NO: 37808 - DNA, 24 bp, Homo sapiens
ttctttgaaaagctgaaaaataca

SEQ ID NO: 37809 - DNA, 24 bp, Homo sapiens
gttctttgaaaagctgaaaaatac

SEQ ID NO: 37810 - DNA, 24 bp, Homo sapiens
atgccaacagggcatttcagaaga

SEQ ID NO: 37811 - DNA, 24 bp, Homo sapiens
aatgccaacagggcatttcagaag

SEQ ID NO: 37812 - DNA, 24 bp, Homo sapiens
taatgccaacagggcatttcagaa

SEQ ID NO: 37813 - DNA, 23 bp, Homo sapiens
caatcctcctgcctcagcctctg

SEQ ID NO: 37814 - DNA, 25 bp, Homo sapiens
caggcttgagtacagtggcatgatc

SEQ ID NO: 37815 - DNA, 25 bp, Homo sapiens
gaagcccatctattctgtagagaga

SEQ ID NO: 37816 - DNA, 25 bp, Homo sapiens
caggaaaacaagctcagggcttcca

SEQ ID NO: 37817 - DNA, 25 bp, Homo sapiens
caggcttgagtacagtggcatgatc

SEQ ID NO: 37818 - DNA, 23 bp, Homo sapiens
aatcctcctgcctcagcctctgg

SEQ ID NO: 37819 - DNA, 23 bp, Homo sapiens
gccctacaagacaaagcccaccc

SEQ ID NO: 37820 - DNA, 24 bp, Homo sapiens
agaattcaatggtaaaagaaaact

SEQ ID NO: 37821 - DNA, 24 bp, Homo sapiens
aagaattcaatggtaaaagaaaac

SEQ ID NO: 37822 - DNA, 24 bp, Homo sapiens
gaagaattcaatggtaaaagaaaa

SEQ ID NO: 37823 - DNA, 24 bp, Homo sapiens
ttttatgatagctacacttctgga

SEQ ID NO: 37824 - DNA, 24 bp, Homo sapiens
gttttatgatagctacacttctgg

SEQ ID NO: 37825 - DNA, 24 bp, Homo sapiens
tgttttatgatagctacacttctg

SEQ ID NO: 37826 - DNA, 23 bp, Homo sapiens
caacctccaccttccagccacct

SEQ ID NO: 37827 - DNA, 25 bp, Homo sapiens
ttctcggtatctgaggaggattggt

SEQ ID NO: 37828 - DNA, 23 bp, Homo sapiens
ggagtgcagtggcgtgatctcag

SEQ ID NO: 37829 - DNA, 24 bp, Homo sapiens
tggaattctaggctgcatggctga

SEQ ID NO: 37830 - DNA, 24 bp, Homo sapiens
ttggaattctaggctgcatggctg

SEQ ID NO: 37831 - DNA, 24 bp, Homo sapiens
attggaattctaggctgcatggct

SEQ ID NO: 37832 - DNA, 23 bp, Homo sapiens
agaagagtggctacctgcggacc

SEQ ID NO: 37833 - DNA, 25 bp, Homo sapiens
atggctgagaggttgaaggaggaga

SEQ ID NO: 37834 - DNA, 23 bp, Homo sapiens
cggctgctggctgttgctgagtc

SEQ ID NO: 37835 - DNA, 23 bp, Homo sapiens
gctgctggctgttgctgagtcgg

SEQ ID NO: 37836 - DNA, 25 bp, Homo sapiens
ctctggacgagacctatgctgatgt

SEQ ID NO: 37837 - DNA, 23 bp, Homo sapiens
tgtgtcaatcatgcgaggctgtg

SEQ ID NO: 37838 - DNA, 24 bp, Homo sapiens
gaaccagcacattcttatatttag

SEQ ID NO: 37839 - DNA, 24 bp, Homo sapiens
tgaaccagcacattcttatattta

SEQ ID NO: 37840 - DNA, 24 bp, Homo sapiens
atgaaccagcacattcttatattt

SEQ ID NO: 37841 - DNA, 24 bp, Homo sapiens
gcacgagccagccacagtccccgc

SEQ ID NO: 37842 - DNA, 24 bp, Homo sapiens
cgcacgagccagccacagtccccg

SEQ ID NO: 37843 - DNA, 24 bp, Homo sapiens
gcgcacgagccagccacagtcccc

SEQ ID NO: 37844 - DNA, 25 bp, Homo sapiens
accaacaaccaagatgaggagacgc

SEQ ID NO: 37845 - DNA, 24 bp, Homo sapiens
gccatagtggacagcgtgaatgcc

SEQ ID NO: 37846 - DNA, 23 bp, Homo sapiens
aggagcaggagtacagcacggag

SEQ ID NO: 37847 - DNA, 24 bp, Homo sapiens
gactaaaaaaagtgagtaatttcc

SEQ ID NO: 37848 - DNA, 24 bp, Homo sapiens
agactaaaaaaagtgagtaatttc

SEQ ID NO: 37849 - DNA, 24 bp, Homo sapiens
aagactaaaaaaagtgagtaattt

SEQ ID NO: 37850 - DNA, 23 bp, Homo sapiens
ggtactgcttgctcctcggcttg

SEQ ID NO: 37851 - DNA, 23 bp, Homo sapiens
cgccatcttcatcgagcgccatg

SEQ ID NO: 37852 - DNA, 23 bp, Homo sapiens
cgcacccaggttcggcccgtagg

SEQ ID NO: 37853 - DNA, 24 bp, Homo sapiens
gggttcctccttctgagagccaaa

SEQ ID NO: 37854 - DNA, 24 bp, Homo sapiens
gacacatcgcctctgcctcccact

SEQ ID NO: 37855 - DNA, 24 bp, Homo sapiens
gctggaacaagtgaatcagatgct

SEQ ID NO: 37856 - DNA, 24 bp, Homo sapiens
attctatgtagattttagtccatg

SEQ ID NO: 37857 - DNA, 24 bp, Homo sapiens
tattctatgtagattttagtccat

SEQ ID NO: 37858 - DNA, 24 bp, Homo sapiens
ttattctatgtagattttagtcca

SEQ ID NO: 37859 - DNA, 23 bp, Homo sapiens
cagcgtggtgttatgttcctgcc

SEQ ID NO: 37860 - DNA, 23 bp, Homo sapiens
cctggcattcctggtggcagcag

SEQ ID NO: 37861 - DNA, 25 bp, Homo sapiens
tcaatggtgaggacccagactgagt

SEQ ID NO: 37862 - DNA, 24 bp, Homo sapiens
tgggggcacaggcatcacacccat

SEQ ID NO: 37863 - DNA, 24 bp, Homo sapiens
ctgggggcacaggcatcacaccca

SEQ ID NO: 37864 - DNA, 24 bp, Homo sapiens
gctgggggcacaggcatcacaccc

SEQ ID NO: 37865 - DNA, 23 bp, Homo sapiens
gtgtgtccctggagcatcccacc

SEQ ID NO: 37866 - DNA, 23 bp, Homo sapiens
gtgtgtgtggctggcgtggagac

SEQ ID NO: 37867 - DNA, 23 bp, Homo sapiens
caccagcatgtcgctgcagagaa

SEQ ID NO: 37868 - DNA, 24 bp, Homo sapiens
agaaataccaggtaagctcttttt

SEQ ID NO: 37869 - DNA, 24 bp, Homo sapiens
cagaaataccaggtaagctctttt

SEQ ID NO: 37870 - DNA, 24 bp, Homo sapiens
acagaaataccaggtaagctcttt

SEQ ID NO: 37871 - DNA, 23 bp, Homo sapiens
gcagtggcacaatcttggctcac

SEQ ID NO: 37872 - DNA, 25 bp, Homo sapiens
cattctcagccaggatggtagatgc

SEQ ID NO: 37873 - DNA, 24 bp, Homo sapiens
ggagtctcactttgtcacccaggc

SEQ ID NO: 37874 - DNA, 24 bp, Homo sapiens
ttgccaaccagacagaaaaggata

SEQ ID NO: 37875 - DNA, 24 bp, Homo sapiens
tttgccaaccagacagaaaaggat

SEQ ID NO: 37876 - DNA, 24 bp, Homo sapiens
ttttgccaaccagacagaaaagga

SEQ ID NO: 37877 - DNA, 23 bp, Homo sapiens
gagcaccgatcccaagttccagc

SEQ ID NO: 37878 - DNA, 23 bp, Homo sapiens
ggagacagcggcggcagcggttg

SEQ ID NO: 37879 - DNA, 25 bp, Homo sapiens
agagagcgaaagagggtgcgaacta

SEQ ID NO: 37880 - DNA, 25 bp, Homo sapiens
agagagcgaaagagggtgcgaacta

SEQ ID NO: 37881 - DNA, 24 bp, Homo sapiens
ccaagttccagctagagaaggtgg

SEQ ID NO: 37882 - DNA, 23 bp, Homo sapiens
ggagacagcggcggcagcggttg

SEQ ID NO: 37883 - DNA, 24 bp, Homo sapiens
ttcttttgaagattatgtgataga

SEQ ID NO: 37884 - DNA, 24 bp, Homo sapiens
tttcttttgaagattatgtgatag

SEQ ID NO: 37885 - DNA, 24 bp, Homo sapiens
ctttcttttgaagattatgtgata

SEQ ID NO: 37886 - DNA, 24 bp, Homo sapiens
ttttagaaacgatcactctcattc

SEQ ID NO: 37887 - DNA, 24 bp, Homo sapiens
attttagaaacgatcactctcatt

SEQ ID NO: 37888 - DNA, 24 bp, Homo sapiens
cattttagaaacgatcactctcat

SEQ ID NO: 37889 - DNA, 24 bp, Homo sapiens
tgtcggatatggtctctactctgc

SEQ ID NO: 37890 - DNA, 24 bp, Homo sapiens
cctgacatactttatctttggaac

SEQ ID NO: 37891 - DNA, 24 bp, Homo sapiens
ttattggataggaatgagaagtgt

SEQ ID NO: 37892 - DNA, 24 bp, Homo sapiens
cttattggataggaatgagaagtg

SEQ ID NO: 37893 - DNA, 24 bp, Homo sapiens
tcttattggataggaatgagaagt

SEQ ID NO: 37894 - DNA, 24 bp, Homo sapiens
ttgcttttcagtcaacttactaca

SEQ ID NO: 37895 - DNA, 24 bp, Homo sapiens
tttgcttttcagtcaacttactac

SEQ ID NO: 37896 - DNA, 24 bp, Homo sapiens
ctttgcttttcagtcaacttacta

SEQ ID NO: 37897 - DNA, 24 bp, Homo sapiens
tttccatttaggtattacttaaaa

SEQ ID NO: 37898 - DNA, 24 bp, Homo sapiens
ttttccatttaggtattacttaaa

SEQ ID NO: 37899 - DNA, 24 bp, Homo sapiens
tttttccatttaggtattacttaa

SEQ ID NO: 37900 - DNA, 25 bp, Homo sapiens
ggtgaccctgctatgactcgatttc

SEQ ID NO: 37901 - DNA, 25 bp, Homo sapiens
tatgggtaaataatcattttaatga

SEQ ID NO: 37902 - DNA, 24 bp, Homo sapiens
ttcctgcattgtacttcagttcca

SEQ ID NO: 37903 - DNA, 24 bp, Homo sapiens
tttcctgcattgtacttcagttcc

SEQ ID NO: 37904 - DNA, 24 bp, Homo sapiens
gtttcctgcattgtacttcagttc

SEQ ID NO: 37905 - DNA, 24 bp, Homo sapiens
ttttgtatttgaattcagattttg

SEQ ID NO: 37906 - DNA, 24 bp, Homo sapiens
tttttgtatttgaattcagatttt

SEQ ID NO: 37907 - DNA, 24 bp, Homo sapiens
gtttttgtatttgaattcagattt

SEQ ID NO: 37908 - DNA, 24 bp, Homo sapiens
tgataataaaggtaattatctaat

SEQ ID NO: 37909 - DNA, 24 bp, Homo sapiens
atgataataaaggtaattatctaa

SEQ ID NO: 37910 - DNA, 24 bp, Homo sapiens
aatgataataaaggtaattatcta

SEQ ID NO: 37911 - DNA, 24 bp, Homo sapiens
tttctctttaggtttctgtttatg

SEQ ID NO: 37912 - DNA, 24 bp, Homo sapiens
ctttctctttaggtttctgtttat

SEQ ID NO: 37913 - DNA, 24 bp, Homo sapiens
cctttctctttaggtttctgttta

SEQ ID NO: 37914 - DNA, 24 bp, Homo sapiens
acccaaacaagatcttgctgctat

SEQ ID NO: 37915 - DNA, 24 bp, Homo sapiens
tacccaaacaagatcttgctgcta

SEQ ID NO: 37916 - DNA, 24 bp, Homo sapiens
ctacccaaacaagatcttgctgct

SEQ ID NO: 37917 - DNA, 24 bp, Homo sapiens
taggactacaggtagagcaagaag

SEQ ID NO: 37918 - DNA, 24 bp, Homo sapiens
ttaggactacaggtagagcaagaa

SEQ ID NO: 37919 - DNA, 24 bp, Homo sapiens
attaggactacaggtagagcaaga

SEQ ID NO: 37920 - DNA, 25 bp, Homo sapiens
cctattgctgctgttgctgttctct

SEQ ID NO: 37921 - DNA, 23 bp, Homo sapiens
ctgaactcctacccaggtccccg

SEQ ID NO: 37922 - DNA, 25 bp, Homo sapiens
gcctagactcaagtctgggtttcag

SEQ ID NO: 37923 - DNA, 25 bp, Homo sapiens
cctattgctgctgttgctgttctct

SEQ ID NO: 37924 - DNA, 25 bp, Homo sapiens
cctagactcaagtctgggtttcagc

SEQ ID NO: 37925 - DNA, 24 bp, Homo sapiens
cttttccatagcattccttctgca

SEQ ID NO: 37926 - DNA, 24 bp, Homo sapiens
tcttttccatagcattccttctgc

SEQ ID NO: 37927 - DNA, 24 bp, Homo sapiens
ttcttttccatagcattccttctg

SEQ ID NO: 37928 - DNA, 24 bp, Homo sapiens
gacatggatagtccaaaagaaact

SEQ ID NO: 37929 - DNA, 24 bp, Homo sapiens
tgacatggatagtccaaaagaaac

SEQ ID NO: 37930 - DNA, 24 bp, Homo sapiens
atgacatggatagtccaaaagaaa

SEQ ID NO: 37931 - DNA, 25 bp, Homo sapiens
ttctgacaagactggaacgcttaca

SEQ ID NO: 37932 - DNA, 25 bp, Homo sapiens
tctgttggtgactcttgaggttgtg

SEQ ID NO: 37933 - DNA, 25 bp, Homo sapiens
tcaagaagatggacaccacctcaga

SEQ ID NO: 37934 - DNA, 23 bp, Homo sapiens
aacagcaagcaacagccatcatg

SEQ ID NO: 37935 - DNA, 24 bp, Homo sapiens
tatcacataatactatgatgaagc

SEQ ID NO: 37936 - DNA, 23 bp, Homo sapiens
caagcggctgctgctgctgttcg

SEQ ID NO: 37937 - DNA, 23 bp, Homo sapiens
cggtggttggtggtggctgttgg

SEQ ID NO: 37938 - DNA, 23 bp, Homo sapiens
gcacggtgcgggccatgagcggg

SEQ ID NO: 37939 - DNA, 23 bp, Homo sapiens
ttggctgtggtggtgggctgtta

SEQ ID NO: 37940 - DNA, 25 bp, Homo sapiens
cgaccctgtggatgaggacattaaa

SEQ ID NO: 37941 - DNA, 25 bp, Homo sapiens
tggaagagattgtggaagagactgc

SEQ ID NO: 37942 - DNA, 24 bp, Homo sapiens
cgccaagaagaatgcaagtattgg

SEQ ID NO: 37943 - DNA, 24 bp, Homo sapiens
acgccaagaagaatgcaagtattg

SEQ ID NO: 37944 - DNA, 24 bp, Homo sapiens
tacgccaagaagaatgcaagtatt

SEQ ID NO: 37945 - DNA, 24 bp, Homo sapiens
ctgtctcacagatccaaagatgtg

SEQ ID NO: 37946 - DNA, 24 bp, Homo sapiens
tctgtctcacagatccaaagatgt

SEQ ID NO: 37947 - DNA, 24 bp, Homo sapiens
gtctgtctcacagatccaaagatg

SEQ ID NO: 37948 - DNA, 24 bp, Homo sapiens
aactctatcaagtacagtaccctg

SEQ ID NO: 37949 - DNA, 24 bp, Homo sapiens
gaactctatcaagtacagtaccct

SEQ ID NO: 37950 - DNA, 24 bp, Homo sapiens
tgaactctatcaagtacagtaccc

SEQ ID NO: 37951 - DNA, 24 bp, Homo sapiens
tcggatcacaggtggggcatgagg

SEQ ID NO: 37952 - DNA, 24 bp, Homo sapiens
ttcggatcacaggtggggcatgag

SEQ ID NO: 37953 - DNA, 24 bp, Homo sapiens
attcggatcacaggtggggcatga

SEQ ID NO: 37954 - DNA, 24 bp, Homo sapiens
ggcatcagcaagttcgaagtcaac

SEQ ID NO: 37955 - DNA, 24 bp, Homo sapiens
cggcatcagcaagttcgaagtcaa

SEQ ID NO: 37956 - DNA, 24 bp, Homo sapiens
acggcatcagcaagttcgaagtca

SEQ ID NO: 37957 - DNA, 24 bp, Homo sapiens
agccgagccagccaagctctactc

SEQ ID NO: 37958 - DNA, 24 bp, Homo sapiens
cagccgagccagccaagctctact

SEQ ID NO: 37959 - DNA, 24 bp, Homo sapiens
gcagccgagccagccaagctctac

SEQ ID NO: 37960 - DNA, 24 bp, Homo sapiens
agtgctggctggtgaggctggggt

SEQ ID NO: 37961 - DNA, 24 bp, Homo sapiens
cagtgctggctggtgaggctgggg

SEQ ID NO: 37962 - DNA, 24 bp, Homo sapiens
ccagtgctggctggtgaggctggg

SEQ ID NO: 37963 - DNA, 24 bp, Homo sapiens
gtgaggctatggtggcagtgatgg

SEQ ID NO: 37964 - DNA, 24 bp, Homo sapiens
gtggcagtggatggtggcaaggac

SEQ ID NO: 37965 - DNA, 24 bp, Homo sapiens
tggtcatctcagcctatgccgtct

SEQ ID NO: 37966 - DNA, 25 bp, Homo sapiens
acatctcagagaattggagggtaga

SEQ ID NO: 37967 - DNA, 25 bp, Homo sapiens
cgatcacccattgcagaagcagttt

SEQ ID NO: 37968 - DNA, 24 bp, Homo sapiens
gtgctgtttgtgtgtctgggtaac

SEQ ID NO: 37969 - DNA, 24 bp, Homo sapiens
aagtaaaaaagaaacgcaagaaat

SEQ ID NO: 37970 - DNA, 24 bp, Homo sapiens
gaagtaaaaaagaaacgcaagaaa

SEQ ID NO: 37971 - DNA, 24 bp, Homo sapiens
agaagtaaaaaagaaacgcaagaa

SEQ ID NO: 37972 - DNA, 24 bp, Homo sapiens
ttaatccttaggttcaaagttgct

SEQ ID NO: 37973 - DNA, 24 bp, Homo sapiens
tttaatccttaggttcaaagttgc

SEQ ID NO: 37974 - DNA, 24 bp, Homo sapiens
ttttaatccttaggttcaaagttg

SEQ ID NO: 37975 - DNA, 24 bp, Homo sapiens
cgaggcaagacctatatctccaca

SEQ ID NO: 37976 - DNA, 24 bp, Homo sapiens
gattccacacagcagcggcagcag

SEQ ID NO: 37977 - DNA, 24 bp, Homo sapiens
cggtgcgactcctaagatgtctcc

SEQ ID NO: 37978 - DNA, 24 bp, Homo sapiens
ggggcaagaagtttgccagtgctc

SEQ ID NO: 37979 - DNA, 24 bp, Homo sapiens
cggggcaagaagtttgccagtgct

SEQ ID NO: 37980 - DNA, 24 bp, Homo sapiens
ccggggcaagaagtttgccagtgc

SEQ ID NO: 37981 - DNA, 24 bp, Homo sapiens
attccgaatccagaagcagctcct

SEQ ID NO: 37982 - DNA, 24 bp, Homo sapiens
caatgtggtggtggtgatggtgga

SEQ ID NO: 37983 - DNA, 24 bp, Homo sapiens
gtggaggaggcttcaagacttgcg

SEQ ID NO: 37984 - DNA, 24 bp, Homo sapiens
caatgtggtggtggtgatggtgga

SEQ ID NO: 37985 - DNA, 24 bp, Homo sapiens
gtggaggaggcttcaagacttgcg

SEQ ID NO: 37986 - DNA, 24 bp, Homo sapiens
tgagaagcagtatgtggtggagcc

SEQ ID NO: 37987 - DNA, 24 bp, Homo sapiens
caatgtggtggtggtgatggtgga

SEQ ID NO: 37988 - DNA, 24 bp, Homo sapiens
gtggaggaggcttcaagacttgcg

SEQ ID NO: 37989 - DNA, 24 bp, Homo sapiens
aatgagaagcagtatgtggtggag

SEQ ID NO: 37990 - DNA, 24 bp, Homo sapiens
ggatgggtgtggaagcagtgatgg

SEQ ID NO: 37991 - DNA, 24 bp, Homo sapiens
agaatctggtggttaagcgtctgg

SEQ ID NO: 37992 - DNA, 24 bp, Homo sapiens
ccgtggttctcgtctcaacatcat

SEQ ID NO: 37993 - DNA, 24 bp, Homo sapiens
gcaaagaaggtgtccacggtggtt

SEQ ID NO: 37994 - DNA, 24 bp, Homo sapiens
atgaagtggctgctgctgctgggt

SEQ ID NO: 37995 - DNA, 24 bp, Homo sapiens
tctccctcgagttgggacccggga

SEQ ID NO: 37996 - DNA, 24 bp, Homo sapiens
tgatcctgcttggaagtaccgctt

SEQ ID NO: 37997 - DNA, 24 bp, Homo sapiens
tccgtgagaccatgaaggagaagg

SEQ ID NO: 37998 - DNA, 24 bp, Homo sapiens
ttggaggcagcagtggtcaaagtg

SEQ ID NO: 37999 - DNA, 24 bp, Homo sapiens
ggctgctgcggcgatgagaatctg

SEQ ID NO: 38000 - DNA, 24 bp, Homo sapiens
ttcagcccatcctgtgtctccctg

SEQ ID NO: 38001 - DNA, 24 bp, Homo sapiens
ggctcgtcagaggtggaagtggta

SEQ ID NO: 38002 - DNA, 24 bp, Homo sapiens
cagttttatgtggggaacaattca

SEQ ID NO: 38003 - DNA, 24 bp, Homo sapiens
tttacctctaatttcagtctcact

SEQ ID NO: 38004 - DNA, 24 bp, Homo sapiens
cttaagtatacaattcagtcacta

SEQ ID NO: 38005 - DNA, 24 bp, Homo sapiens
agtcagagttgtgagagcactgga

SEQ ID NO: 38006 - DNA, 24 bp, Homo sapiens
tgaaagccaagccctaagccagag

SEQ ID NO: 38007 - DNA, 24 bp, Homo sapiens
tcaccaggtcaagacatacagttg

SEQ ID NO: 38008 - DNA, 24 bp, Homo sapiens
gagctggaaaggtatcagaaacat

SEQ ID NO: 38009 - DNA, 24 bp, Homo sapiens
agagctggaaaggtatcagaaaca

SEQ ID NO: 38010 - DNA, 24 bp, Homo sapiens
aagagctggaaaggtatcagaaac

SEQ ID NO: 38011 - DNA, 24 bp, Homo sapiens
atgcagaacaggttcaagaatata

SEQ ID NO: 38012 - DNA, 24 bp, Homo sapiens
aatgcagaacaggttcaagaatat

SEQ ID NO: 38013 - DNA, 24 bp, Homo sapiens
caatgcagaacaggttcaagaata

SEQ ID NO: 38014 - DNA, 24 bp, Homo sapiens
aaatgaaacagatgactaggcggt

SEQ ID NO: 38015 - DNA, 24 bp, Homo sapiens
gaaatgaaacagatgactaggcgg

SEQ ID NO: 38016 - DNA, 24 bp, Homo sapiens
tgaaatgaaacagatgactaggcg

SEQ ID NO: 38017 - DNA, 24 bp, Homo sapiens
ctcagactcgggaggacatcacat

SEQ ID NO: 38018 - DNA, 24 bp, Homo sapiens
cccgtgggattctaccagagggtg

SEQ ID NO: 38019 - DNA, 24 bp, Homo sapiens
gtccagcaccccatcctcgcccac

SEQ ID NO: 38020 - DNA, 24 bp, Homo sapiens
acactgatgaggtctcttttattc

SEQ ID NO: 38021 - DNA, 24 bp, Homo sapiens
aacactgatgaggtctcttttatt

SEQ ID NO: 38022 - DNA, 24 bp, Homo sapiens
caacactgatgaggtctcttttat

SEQ ID NO: 38023 - DNA, 24 bp, Homo sapiens
gtcatcggcagaggagtgagctct

SEQ ID NO: 38024 - DNA, 24 bp, Homo sapiens
cgtcatcggcagaggagtgagctc

SEQ ID NO: 38025 - DNA, 24 bp, Homo sapiens
acgtcatcggcagaggagtgagct

SEQ ID NO: 38026 - DNA, 24 bp, Homo sapiens
tctcttaacaggttcttcattttg

SEQ ID NO: 38027 - DNA, 24 bp, Homo sapiens
ttctcttaacaggttcttcatttt

SEQ ID NO: 38028 - DNA, 24 bp, Homo sapiens
tttctcttaacaggttcttcattt

SEQ ID NO: 38029 - DNA, 24 bp, Homo sapiens
aagtcagcaagaccaacgggattc

SEQ ID NO: 38030 - DNA, 24 bp, Homo sapiens
aaagtcagcaagaccaacgggatt

SEQ ID NO: 38031 - DNA, 24 bp, Homo sapiens
taaagtcagcaagaccaacgggat

SEQ ID NO: 38032 - DNA, 24 bp, Homo sapiens
ttccagtctcttctcaccgaagtg

SEQ ID NO: 38033 - DNA, 24 bp, Homo sapiens
agtggcggtggtggagacatccac

SEQ ID NO: 38034 - DNA, 24 bp, Homo sapiens
acgcagtacttgcttaggatggcc

SEQ ID NO: 38035 - DNA, 24 bp, Homo sapiens
tcatctttcaggtgaagaattttc

SEQ ID NO: 38036 - DNA, 24 bp, Homo sapiens
ctcatctttcaggtgaagaatttt

SEQ ID NO: 38037 - DNA, 24 bp, Homo sapiens
tctcatctttcaggtgaagaattt

SEQ ID NO: 38038 - DNA, 24 bp, Homo sapiens
aaacaatacagagaagtcaaaatg

SEQ ID NO: 38039 - DNA, 24 bp, Homo sapiens
taaacaatacagagaagtcaaaat

SEQ ID NO: 38040 - DNA, 24 bp, Homo sapiens
ttaaacaatacagagaagtcaaaa

SEQ ID NO: 38041 - DNA, 24 bp, Homo sapiens
aacctgatgagagaagtcaaaatg

SEQ ID NO: 38042 - DNA, 24 bp, Homo sapiens
aaacctgatgagagaagtcaaaat

SEQ ID NO: 38043 - DNA, 24 bp, Homo sapiens
aaaacctgatgagagaagtcaaaa

SEQ ID NO: 38044 - DNA, 24 bp, Homo sapiens
aagtcaagcctcaagatgctcagc

SEQ ID NO: 38045 - DNA, 24 bp, Homo sapiens
tcttgtggagtcttctattgctgt

SEQ ID NO: 38046 - DNA, 24 bp, Homo sapiens
tggttcttgagatggtacaactgg

SEQ ID NO: 38047 - DNA, 24 bp, Homo sapiens
taattgccaagaggaagtttgcta

SEQ ID NO: 38048 - DNA, 24 bp, Homo sapiens
ataattgccaagaggaagtttgct

SEQ ID NO: 38049 - DNA, 24 bp, Homo sapiens
aataattgccaagaggaagtttgc

SEQ ID NO: 38050 - DNA, 24 bp, Homo sapiens
agacgctgctcctgatgagaaggt

SEQ ID NO: 38051 - DNA, 24 bp, Homo sapiens
aaggcggtggcagatacaagagat

SEQ ID NO: 38052 - DNA, 24 bp, Homo sapiens
aaggtcatccaaggaggaagccga

SEQ ID NO: 38053 - DNA, 24 bp, Homo sapiens
taaatattaaggtgacacataaaa

SEQ ID NO: 38054 - DNA, 24 bp, Homo sapiens
ttaaatattaaggtgacacataaa

SEQ ID NO: 38055 - DNA, 24 bp, Homo sapiens
attaaatattaaggtgacacataa

SEQ ID NO: 38056 - DNA, 24 bp, Homo sapiens
ataaacattatgtaagtttgattt

SEQ ID NO: 38057 - DNA, 24 bp, Homo sapiens
gataaacattatgtaagtttgatt

SEQ ID NO: 38058 - DNA, 24 bp, Homo sapiens
agataaacattatgtaagtttgat

SEQ ID NO: 38059 - DNA, 24 bp, Homo sapiens
aaagtatccaggtaagatatttta

SEQ ID NO: 38060 - DNA, 24 bp, Homo sapiens
gaaagtatccaggtaagatatttt

SEQ ID NO: 38061 - DNA, 24 bp, Homo sapiens
ggaaagtatccaggtaagatattt

SEQ ID NO: 38062 - DNA, 24 bp, Homo sapiens
gaaaaggagagaatttttatcaaa

SEQ ID NO: 38063 - DNA, 24 bp, Homo sapiens
agaaaaggagagaatttttatcaa

SEQ ID NO: 38064 - DNA, 24 bp, Homo sapiens
gagaaaaggagagaatttttatca

SEQ ID NO: 38065 - DNA, 24 bp, Homo sapiens
gggtgggagtatatgaaacctgat

SEQ ID NO: 38066 - DNA, 24 bp, Homo sapiens
agaagtaatcttgaagagccacta

SEQ ID NO: 38067 - DNA, 24 bp, Homo sapiens
aaaacatattgccagactttcaca

SEQ ID NO: 38068 - DNA, 24 bp, Homo sapiens
gaagcattcagaacttttttagaa

SEQ ID NO: 38069 - DNA, 24 bp, Homo sapiens
ggaagcattcagaacttttttaga

SEQ ID NO: 38070 - DNA, 24 bp, Homo sapiens
gggaagcattcagaacttttttag

SEQ ID NO: 38071 - DNA, 24 bp, Homo sapiens
attatgaaaaggagaatttagttg

SEQ ID NO: 38072 - DNA, 24 bp, Homo sapiens
tattatgaaaaggagaatttagtt

SEQ ID NO: 38073 - DNA, 24 bp, Homo sapiens
ttattatgaaaaggagaatttagt

SEQ ID NO: 38074 - DNA, 24 bp, Homo sapiens
aatctttgtaggacctactaaatg

SEQ ID NO: 38075 - DNA, 24 bp, Homo sapiens
taatctttgtaggacctactaaat

SEQ ID NO: 38076 - DNA, 24 bp, Homo sapiens
ctaatctttgtaggacctactaaa

SEQ ID NO: 38077 - DNA, 24 bp, Homo sapiens
attagataaagggcaaataatagt

SEQ ID NO: 38078 - DNA, 24 bp, Homo sapiens
aattagataaagggcaaataatag

SEQ ID NO: 38079 - DNA, 24 bp, Homo sapiens
aaattagataaagggcaaataata

SEQ ID NO: 38080 - DNA, 24 bp, Homo sapiens
actttctgcaggtcagaagtgcac

SEQ ID NO: 38081 - DNA, 24 bp, Homo sapiens
aactttctgcaggtcagaagtgca

SEQ ID NO: 38082 - DNA, 24 bp, Homo sapiens
taactttctgcaggtcagaagtgc

SEQ ID NO: 38083 - DNA, 24 bp, Homo sapiens
cgcaagatccgagaccagtacctc

SEQ ID NO: 38084 - DNA, 24 bp, Homo sapiens
gagatccatgagagccgcacgaag

SEQ ID NO: 38085 - DNA, 24 bp, Homo sapiens
ctgaactccgagcggctcaagtcc

SEQ ID NO: 38086 - DNA, 24 bp, Homo sapiens
tgctgggagtggctgctggctggc

SEQ ID NO: 38087 - DNA, 24 bp, Homo sapiens
ctgctgggagtggctgctggctgg

SEQ ID NO: 38088 - DNA, 24 bp, Homo sapiens
cctgctgggagtggctgctggctg

SEQ ID NO: 38089 - DNA, 24 bp, Homo sapiens
gcttcctcttcggaatctaccagc

SEQ ID NO: 38090 - DNA, 24 bp, Homo sapiens
ccgccctgggcctcaccccaaacc

SEQ ID NO: 38091 - DNA, 24 bp, Homo sapiens
cgtctcagccggctaaaggacttc

SEQ ID NO: 38092 - DNA, 24 bp, Homo sapiens
accacatcactaacgccagccagt

SEQ ID NO: 38093 - DNA, 24 bp, Homo sapiens
cggcaacagcagcagtggtggcaa

SEQ ID NO: 38094 - DNA, 24 bp, Homo sapiens
tcaacggctacatccagaagatca

SEQ ID NO: 38095 - DNA, 24 bp, Homo sapiens
aatgcatggtggttaaaacttacc

SEQ ID NO: 38096 - DNA, 24 bp, Homo sapiens
gaatgcatggtggttaaaacttac

SEQ ID NO: 38097 - DNA, 24 bp, Homo sapiens
agaatgcatggtggttaaaactta

SEQ ID NO: 38098 - DNA, 24 bp, Homo sapiens
ggactgctggaacctggctgtgcg

SEQ ID NO: 38099 - DNA, 24 bp, Homo sapiens
cgagaagctgccgccgcctctgcc

SEQ ID NO: 38100 - DNA, 24 bp, Homo sapiens
gagccttagaaaccggccccggat

SEQ ID NO: 38101 - DNA, 24 bp, Homo sapiens
tcgagaactccgccagcgagtcgt

SEQ ID NO: 38102 - DNA, 24 bp, Homo sapiens
ccgccgccgccaccccatgacatg

SEQ ID NO: 38103 - DNA, 24 bp, Homo sapiens
ctcttgtccccgcaggtcgcagcc

SEQ ID NO: 38104 - DNA, 24 bp, Homo sapiens
gtggccttcctgtggacctttggg

SEQ ID NO: 38105 - DNA, 24 bp, Homo sapiens
ggtggccttcctgtggacctttgg

SEQ ID NO: 38106 - DNA, 24 bp, Homo sapiens
aggtggccttcctgtggacctttg

SEQ ID NO: 38107 - DNA, 24 bp, Homo sapiens
ttaagtgaaatgtaagttgtggtt

SEQ ID NO: 38108 - DNA, 24 bp, Homo sapiens
tttaagtgaaatgtaagttgtggt

SEQ ID NO: 38109 - DNA, 24 bp, Homo sapiens
atttaagtgaaatgtaagttgtgg

SEQ ID NO: 38110 - DNA, 24 bp, Homo sapiens
cccggagcaaggtggctgggagcc

SEQ ID NO: 38111 - DNA, 24 bp, Homo sapiens
tcccggagcaaggtggctgggagc

SEQ ID NO: 38112 - DNA, 24 bp, Homo sapiens
gtcccggagcaaggtggctgggag

SEQ ID NO: 38113 - DNA, 23 bp, Homo sapiens
gctcttgccgcctcttcccactg

SEQ ID NO: 38114 - DNA, 23 bp, Homo sapiens
gggatacaccttcacgctcacgg

SEQ ID NO: 38115 - DNA, 24 bp, Homo sapiens
aacaagacgctggtgctggatgag

SEQ ID NO: 38116 - DNA, 23 bp, Homo sapiens
gtggctgtggctgtggctgtctc

SEQ ID NO: 38117 - DNA, 23 bp, Homo sapiens
gtgagtgttgcgtggctcctgtc

SEQ ID NO: 38118 - DNA, 23 bp, Homo sapiens
gccactgaaggtcttgctggaag

SEQ ID NO: 38119 - DNA, 24 bp, Homo sapiens
aatggaaccgcttggatctacaca

SEQ ID NO: 38120 - DNA, 24 bp, Homo sapiens
aaatggaaccgcttggatctacac

SEQ ID NO: 38121 - DNA, 24 bp, Homo sapiens
gaaatggaaccgcttggatctaca

SEQ ID NO: 38122 - DNA, 24 bp, Homo sapiens
ccagaaaatcggtttgatgaaatc

SEQ ID NO: 38123 - DNA, 24 bp, Homo sapiens
tccagaaaatcggtttgatgaaat

SEQ ID NO: 38124 - DNA, 24 bp, Homo sapiens
gtccagaaaatcggtttgatgaaa

SEQ ID NO: 38125 - DNA, 23 bp, Homo sapiens
atgtcgccaatgctgtgctggat

SEQ ID NO: 38126 - DNA, 23 bp, Homo sapiens
ccctgtggaagcggtgaagatgc

SEQ ID NO: 38127 - DNA, 23 bp, Homo sapiens
aagtgctgtgctgctgccatcat

SEQ ID NO: 38128 - DNA, 25 bp, Homo sapiens
aatgttgacaccatctggcatctat

SEQ ID NO: 38129 - DNA, 24 bp, Homo sapiens
gtgtggtgctggctatggctactt

SEQ ID NO: 38130 - DNA, 24 bp, Homo sapiens
gctccgcttctttccttcactcag

SEQ ID NO: 38131 - DNA, 24 bp, Homo sapiens
gacggtggcaggtggcacagtgta

SEQ ID NO: 38132 - DNA, 24 bp, Homo sapiens
cgacggtggcaggtggcacagtgt

SEQ ID NO: 38133 - DNA, 24 bp, Homo sapiens
gcgacggtggcaggtggcacagtg

SEQ ID NO: 38134 - DNA, 24 bp, Homo sapiens
agccactgcactccatcttgggca

SEQ ID NO: 38135 - DNA, 24 bp, Homo sapiens
tagccactgcactccatcttgggc

SEQ ID NO: 38136 - DNA, 24 bp, Homo sapiens
atagccactgcactccatcttggg

SEQ ID NO: 38137 - DNA, 24 bp, Homo sapiens
aagtaaaagagcaataccaggacg

SEQ ID NO: 38138 - DNA, 24 bp, Homo sapiens
aaagtaaaagagcaataccaggac

SEQ ID NO: 38139 - DNA, 24 bp, Homo sapiens
gaaagtaaaagagcaataccagga

SEQ ID NO: 38140 - DNA, 24 bp, Homo sapiens
tttcttaatgggtaagtgatcaaa

SEQ ID NO: 38141 - DNA, 24 bp, Homo sapiens
atttcttaatgggtaagtgatcaa

SEQ ID NO: 38142 - DNA, 24 bp, Homo sapiens
catttcttaatgggtaagtgatca

SEQ ID NO: 38143 - DNA, 23 bp, Homo sapiens
ctgtgtgctgctgctgtgtggag

SEQ ID NO: 38144 - DNA, 25 bp, Homo sapiens
agcaatcatggatgcaatgaagaga

SEQ ID NO: 38145 - DNA, 24 bp, Homo sapiens
cactgctctactccggggtcttcg

SEQ ID NO: 38146 - DNA, 24 bp, Homo sapiens
ccccgccgccgtcgccgccatgac

SEQ ID NO: 38147 - DNA, 24 bp, Homo sapiens
cgcgtttgtagctccggccccgcc

SEQ ID NO: 38148 - DNA, 24 bp, Homo sapiens
ccgtgggagtctgctacaccattt

SEQ ID NO: 38149 - DNA, 24 bp, Homo sapiens
cactgctctactccggggtcttcg

SEQ ID NO: 38150 - DNA, 24 bp, Homo sapiens
ccccgccgccgtcgccgccatgac

SEQ ID NO: 38151 - DNA, 24 bp, Homo sapiens
agttgaaaaaaaacagctggaagc

SEQ ID NO: 38152 - DNA, 24 bp, Homo sapiens
aagttgaaaaaaaacagctggaag

SEQ ID NO: 38153 - DNA, 24 bp, Homo sapiens
gaagttgaaaaaaaacagctggaa

SEQ ID NO: 38154 - DNA, 23 bp, Homo sapiens
cacacacgcacacgcacacacgg

SEQ ID NO: 38155 - DNA, 23 bp, Homo sapiens
gcgtacacactgggtctccaggc

SEQ ID NO: 38156 - DNA, 23 bp, Homo sapiens
cgtcgccgcatccccggcagcag

SEQ ID NO: 38157 - DNA, 25 bp, Homo sapiens
ggaagggcggatagtttgtgtctgc

SEQ ID NO: 38158 - DNA, 25 bp, Homo sapiens
catcaacagtattcggtcgggagcc

SEQ ID NO: 38159 - DNA, 25 bp, Homo sapiens
aagtgaaggcaaggaaggacaggtg

SEQ ID NO: 38160 - DNA, 24 bp, Homo sapiens
gcatcggccaggcacagttctcgc

SEQ ID NO: 38161 - DNA, 24 bp, Homo sapiens
ggcatcggccaggcacagttctcg

SEQ ID NO: 38162 - DNA, 24 bp, Homo sapiens
aggcatcggccaggcacagttctc

SEQ ID NO: 38163 - DNA, 23 bp, Homo sapiens
tgtgtcctctcctctccgcatcc

SEQ ID NO: 38164 - DNA, 23 bp, Homo sapiens
gctgctgctggctgtgaagactt

SEQ ID NO: 38165 - DNA, 24 bp, Homo sapiens
ctcttggagccttggaagcctctc

SEQ ID NO: 38166 - DNA, 24 bp, Homo sapiens
cgagaacgaagggccccaagaagg

SEQ ID NO: 38167 - DNA, 24 bp, Homo sapiens
tcgagaacgaagggccccaagaag

SEQ ID NO: 38168 - DNA, 24 bp, Homo sapiens
gtcgagaacgaagggccccaagaa

SEQ ID NO: 38169 - DNA, 25 bp, Homo sapiens
ttgttctactccaagaagtcgcagc

SEQ ID NO: 38170 - DNA, 23 bp, Homo sapiens
ctcgtctgccgcctcagcctcag

SEQ ID NO: 38171 - DNA, 23 bp, Homo sapiens
caggtcaagctggagacgcgcca

SEQ ID NO: 38172 - DNA, 24 bp, Homo sapiens
caactttcaaggtggcgaggggac

SEQ ID NO: 38173 - DNA, 24 bp, Homo sapiens
ccaactttcaaggtggcgagggga

SEQ ID NO: 38174 - DNA, 24 bp, Homo sapiens
gccaactttcaaggtggcgagggg

SEQ ID NO: 38175 - DNA, 24 bp, Homo sapiens
gtgacattaaggtagttcataaca

SEQ ID NO: 38176 - DNA, 24 bp, Homo sapiens
agtgacattaaggtagttcataac

SEQ ID NO: 38177 - DNA, 24 bp, Homo sapiens
aagtgacattaaggtagttcataa

SEQ ID NO: 38178 - DNA, 24 bp, Homo sapiens
ccaatagcaggaaaacttttcttt

SEQ ID NO: 38179 - DNA, 24 bp, Homo sapiens
tccaatagcaggaaaacttttctt

SEQ ID NO: 38180 - DNA, 24 bp, Homo sapiens
atccaatagcaggaaaacttttct

SEQ ID NO: 38181 - DNA, 24 bp, Homo sapiens
tttatgacaaggtgaagttcacgt

SEQ ID NO: 38182 - DNA, 24 bp, Homo sapiens
atttatgacaaggtgaagttcacg

SEQ ID NO: 38183 - DNA, 24 bp, Homo sapiens
aatttatgacaaggtgaagttcac

SEQ ID NO: 38184 - DNA, 24 bp, Homo sapiens
atcatgccacaacagagtttcttg

SEQ ID NO: 38185 - DNA, 24 bp, Homo sapiens
tatcatgccacaacagagtttctt

SEQ ID NO: 38186 - DNA, 24 bp, Homo sapiens
ctatcatgccacaacagagtttct

SEQ ID NO: 38187 - DNA, 24 bp, Homo sapiens
tttctttaaaggacacttatttta

SEQ ID NO: 38188 - DNA, 24 bp, Homo sapiens
ttttctttaaaggacacttatttt

SEQ ID NO: 38189 - DNA, 24 bp, Homo sapiens
tttttctttaaaggacacttattt

SEQ ID NO: 38190 - DNA, 23 bp, Homo sapiens
cttcgggctcggggttttggcgg

SEQ ID NO: 38191 - DNA, 23 bp, Homo sapiens
gccctggtggcagtggctgaagt

SEQ ID NO: 38192 - DNA, 23 bp, Homo sapiens
ggcttcggcggctgcggcgtctg

SEQ ID NO: 38193 - DNA, 24 bp, Homo sapiens
caagaggtggctggtggtgaagga

SEQ ID NO: 38194 - DNA, 24 bp, Homo sapiens
caggtgccatctcatttgttcagc

SEQ ID NO: 38195 - DNA, 24 bp, Homo sapiens
gattctcaagtgcagcagctaccg

SEQ ID NO: 38196 - DNA, 24 bp, Homo sapiens
actccatcctcaatgcctacctgc

SEQ ID NO: 38197 - DNA, 24 bp, Homo sapiens
gagccagcacttcctctacattga

SEQ ID NO: 38198 - DNA, 24 bp, Homo sapiens
aaggtgggcgatgagattgtggac

SEQ ID NO: 38199 - DNA, 24 bp, Homo sapiens
tgcacttccagatctcagatatcc

SEQ ID NO: 38200 - DNA, 24 bp, Homo sapiens
ctgcacttccagatctcagatatc

SEQ ID NO: 38201 - DNA, 24 bp, Homo sapiens
tctgcacttccagatctcagatat

SEQ ID NO: 38202 - DNA, 24 bp, Homo sapiens
ttctttttcagaaatttggatgaa

SEQ ID NO: 38203 - DNA, 24 bp, Homo sapiens
cttctttttcagaaatttggatga

SEQ ID NO: 38204 - DNA, 24 bp, Homo sapiens
acttctttttcagaaatttggatg

SEQ ID NO: 38205 - DNA, 24 bp, Homo sapiens
gaagtgtctaggctgttcttggag

SEQ ID NO: 38206 - DNA, 24 bp, Homo sapiens
ccaagaagtgaatctcgaaccgca

SEQ ID NO: 38207 - DNA, 24 bp, Homo sapiens
gcacttctgtggaggcaccttgat

SEQ ID NO: 38208 - DNA, 24 bp, Homo sapiens
acataagagaggccattaaaaaca

SEQ ID NO: 38209 - DNA, 24 bp, Homo sapiens
gacataagagaggccattaaaaac

SEQ ID NO: 38210 - DNA, 24 bp, Homo sapiens
agacataagagaggccattaaaaa

SEQ ID NO: 38211 - DNA, 23 bp, Homo sapiens
gccagcgtcaagaccgtgaagac

SEQ ID NO: 38212 - DNA, 23 bp, Homo sapiens
cccggcccaagggcgacttctcc

SEQ ID NO: 38213 - DNA, 23 bp, Homo sapiens
gtcgatggcagccgggacgagct

SEQ ID NO: 38214 - DNA, 24 bp, Homo sapiens
ctttggcaaaaaaaaaaaaaaatc

SEQ ID NO: 38215 - DNA, 24 bp, Homo sapiens
actttggcaaaaaaaaaaaaaaat

SEQ ID NO: 38216 - DNA, 24 bp, Homo sapiens
gactttggcaaaaaaaaaaaaaaa

SEQ ID NO: 38217 - DNA, 24 bp, Homo sapiens
gccttcactgccgacctgttctcc

SEQ ID NO: 38218 - DNA, 24 bp, Homo sapiens
tcagaaccacacgttgcagaggct

SEQ ID NO: 38219 - DNA, 24 bp, Homo sapiens
catctgctgagccgcctctgccag

SEQ ID NO: 38220 - DNA, 24 bp, Homo sapiens
tcctacaataaagtaagctagaga

SEQ ID NO: 38221 - DNA, 24 bp, Homo sapiens
tattcattaaatggaagtgggtca

SEQ ID NO: 38222 - DNA, 24 bp, Homo sapiens
agaaaatcataagaaagagaaaat

SEQ ID NO: 38223 - DNA, 24 bp, Homo sapiens
gccactaaggagaccgagggattc

SEQ ID NO: 38224 - DNA, 24 bp, Homo sapiens
gggaggactggaatgtggagaagg

SEQ ID NO: 38225 - DNA, 24 bp, Homo sapiens
gagaagcacgcagacaaggaggat

SEQ ID NO: 38226 - DNA, 24 bp, Homo sapiens
gtggtgtccgatggcaagaggttc

SEQ ID NO: 38227 - DNA, 24 bp, Homo sapiens
caggtggtcttctctgctgaggag

SEQ ID NO: 38228 - DNA, 24 bp, Homo sapiens
gagaagcacgcagacaaggaggat

SEQ ID NO: 38229 - DNA, 24 bp, Homo sapiens
aatgtatggtgttccaaatgacct

SEQ ID NO: 38230 - DNA, 24 bp, Homo sapiens
gaatgtatggtgttccaaatgacc

SEQ ID NO: 38231 - DNA, 24 bp, Homo sapiens
agaatgtatggtgttccaaatgac

SEQ ID NO: 38232 - DNA, 24 bp, Homo sapiens
ccacctgccagtctattgccttcc

SEQ ID NO: 38233 - DNA, 23 bp, Homo sapiens
gcctgctctgctgtgcctgtgta

SEQ ID NO: 38234 - DNA, 23 bp, Homo sapiens
cctatgccctgaccgttgtgtgg

SEQ ID NO: 38235 - DNA, 24 bp, Homo sapiens
tttctctttagcaaaatgatcaac

SEQ ID NO: 38236 - DNA, 24 bp, Homo sapiens
ttttctctttagcaaaatgatcaa

SEQ ID NO: 38237 - DNA, 24 bp, Homo sapiens
attttctctttagcaaaatgatca

SEQ ID NO: 38238 - DNA, 24 bp, Homo sapiens
acatgaagaaggtacacattgaat

SEQ ID NO: 38239 - DNA, 24 bp, Homo sapiens
aacatgaagaaggtacacattgaa

SEQ ID NO: 38240 - DNA, 24 bp, Homo sapiens
gaacatgaagaaggtacacattga

SEQ ID NO: 38241 - DNA, 24 bp, Homo sapiens
acatgaaaaaggtagataattaag

SEQ ID NO: 38242 - DNA, 24 bp, Homo sapiens
aacatgaaaaaggtagataattaa

SEQ ID NO: 38243 - DNA, 24 bp, Homo sapiens
caacatgaaaaaggtagataatta

SEQ ID NO: 38244 - DNA, 24 bp, Homo sapiens
aggacttcacggaatctgagagcg

SEQ ID NO: 38245 - DNA, 24 bp, Homo sapiens
gatccactgccgctcaccctccgc

SEQ ID NO: 38246 - DNA, 24 bp, Homo sapiens
gacctctcagctggcgtcaactgc

SEQ ID NO: 38247 - DNA, 23 bp, Homo sapiens
ccagcaacaaggtcaagagcgac

SEQ ID NO: 38248 - DNA, 25 bp, Homo sapiens
tacgactcctccaaccaggtcaagg

SEQ ID NO: 38249 - DNA, 24 bp, Homo sapiens
tgagcaagatgaacaagagccgcc

SEQ ID NO: 38250 - DNA, 24 bp, Homo sapiens
aattcaactgagtatttaaaccca

SEQ ID NO: 38251 - DNA, 24 bp, Homo sapiens
taattcaactgagtatttaaaccc

SEQ ID NO: 38252 - DNA, 24 bp, Homo sapiens
ctaattcaactgagtatttaaacc

SEQ ID NO: 38253 - DNA, 25 bp, Homo sapiens
aaggaggagagcactgttactacca

SEQ ID NO: 38254 - DNA, 24 bp, Homo sapiens
agagacacattgaacatggaggca

SEQ ID NO: 38255 - DNA, 25 bp, Homo sapiens
cgcagttgactcatgttgaccaagc

SEQ ID NO: 38256 - DNA, 25 bp, Homo sapiens
cctccttcctctaccgcactatcca

SEQ ID NO: 38257 - DNA, 23 bp, Homo sapiens
agacttggctgtggtgctggaga

SEQ ID NO: 38258 - DNA, 24 bp, Homo sapiens
tgcctgtggtcaacgaatgtggtc

SEQ ID NO: 38259 - DNA, 24 bp, Homo sapiens
gtcaactcgtccagcctcctcctg

SEQ ID NO: 38260 - DNA, 24 bp, Homo sapiens
gtaccagacagagcccacccgcag

SEQ ID NO: 38261 - DNA, 24 bp, Homo sapiens
caagtggacttcgccagtgccagt

SEQ ID NO: 38262 - DNA, 24 bp, Homo sapiens
tgggcacatgatagccttcctggg

SEQ ID NO: 38263 - DNA, 24 bp, Homo sapiens
gaggtccagcctctgctgaagctc

SEQ ID NO: 38264 - DNA, 24 bp, Homo sapiens
gacgagcacacccccagccccatt

SEQ ID NO: 38265 - DNA, 24 bp, Homo sapiens
ccaggggaaagatgcagctgtatc

SEQ ID NO: 38266 - DNA, 24 bp, Homo sapiens
cccaggggaaagatgcagctgtat

SEQ ID NO: 38267 - DNA, 24 bp, Homo sapiens
acccaggggaaagatgcagctgta

SEQ ID NO: 38268 - DNA, 23 bp, Homo sapiens
agaacttgccgccagaatgctcc

SEQ ID NO: 38269 - DNA, 23 bp, Homo sapiens
gtgctggtgctgctgttcgtctc

SEQ ID NO: 38270 - DNA, 25 bp, Homo sapiens
tggcagaactgtagcacctcttcct

SEQ ID NO: 38271 - DNA, 23 bp, Homo sapiens
agaacttgccgccagaatgctcc

SEQ ID NO: 38272 - DNA, 23 bp, Homo sapiens
tgctgagtatcatcgtcctccac

SEQ ID NO: 38273 - DNA, 23 bp, Homo sapiens
gtgctggtgctgctgttcgtctc

SEQ ID NO: 38274 - DNA, 24 bp, Homo sapiens
tcttggtcaagagattcataaaag

SEQ ID NO: 38275 - DNA, 24 bp, Homo sapiens
atcttggtcaagagattcataaaa

SEQ ID NO: 38276 - DNA, 24 bp, Homo sapiens
catcttggtcaagagattcataaa

SEQ ID NO: 38277 - DNA, 24 bp, Homo sapiens
gttatttagagggtaataattgct

SEQ ID NO: 38278 - DNA, 24 bp, Homo sapiens
agttatttagagggtaataattgc

SEQ ID NO: 38279 - DNA, 24 bp, Homo sapiens
aagttatttagagggtaataattg

SEQ ID NO: 38280 - DNA, 24 bp, Homo sapiens
ttataataggatgtaactggagag

SEQ ID NO: 38281 - DNA, 24 bp, Homo sapiens
attataataggatgtaactggaga

SEQ ID NO: 38282 - DNA, 24 bp, Homo sapiens
attataataggatgtaactggaga

SEQ ID NO: 38283 - DNA, 24 bp, Homo sapiens
tgaaggcttaacgatgtcaccatt

SEQ ID NO: 38284 - DNA, 24 bp, Homo sapiens
ttgaaggcttaacgatgtcaccat

SEQ ID NO: 38285 - DNA, 24 bp, Homo sapiens
tttgaaggcttaacgatgtcacca

SEQ ID NO: 38286 - DNA, 24 bp, Homo sapiens
acatccgtggctgaaggtagaagg

SEQ ID NO: 38287 - DNA, 23 bp, Homo sapiens
gcacggtggttcacgcctgtaat

SEQ ID NO: 38288 - DNA, 23 bp, Homo sapiens
cattttgccagggccttcttgct

SEQ ID NO: 38289 - DNA, 23 bp, Homo sapiens
ctttggcgccctggctggagtgc

SEQ ID NO: 38290 - DNA, 23 bp, Homo sapiens
ctgagcggactgatctgcggagg

SEQ ID NO: 38291 - DNA, 23 bp, Homo sapiens
gcggcagttctgagtggcaaatg

SEQ ID NO: 38292 - DNA, 23 bp, Homo sapiens
aagagcagccagaagcagcacag

SEQ ID NO: 38293 - DNA, 23 bp, Homo sapiens
ccgctgctgctgttgctcctggc

SEQ ID NO: 38294 - DNA, 23 bp, Homo sapiens
agtcgctcgcccttggtttctgg

SEQ ID NO: 38295 - DNA, 23 bp, Homo sapiens
tctcaggactgacagccgagtgg

SEQ ID NO: 38296 - DNA, 23 bp, Homo sapiens
cctgttgctgctcctgctgccgc

SEQ ID NO: 38297 - DNA, 23 bp, Homo sapiens
tccggacaggccgagatgacgcc

SEQ ID NO: 38298 - DNA, 23 bp, Homo sapiens
gaccccgccgcccgcccgctgag

SEQ ID NO: 38299 - DNA, 24 bp, Homo sapiens
tcccgaccctacacagagattgcc

SEQ ID NO: 38300 - DNA, 24 bp, Homo sapiens
agtaaacaccctgcccagtgacct

SEQ ID NO: 38301 - DNA, 23 bp, Homo sapiens
tgagcaggagccagaccaggagg

SEQ ID NO: 38302 - DNA, 24 bp, Homo sapiens
taatttttcaggtgttccttaagt

SEQ ID NO: 38303 - DNA, 24 bp, Homo sapiens
ttaatttttcaggtgttccttaag

SEQ ID NO: 38304 - DNA, 24 bp, Homo sapiens
tttaatttttcaggtgttccttaa

SEQ ID NO: 38305 - DNA, 24 bp, Homo sapiens
attcatttcagaacatatttattg

SEQ ID NO: 38306 - DNA, 24 bp, Homo sapiens
cattcatttcagaacatatttatt

SEQ ID NO: 38307 - DNA, 24 bp, Homo sapiens
acattcatttcagaacatatttat

SEQ ID NO: 38308 - DNA, 24 bp, Homo sapiens
cgttatttaatgtgagtagcacag

SEQ ID NO: 38309 - DNA, 24 bp, Homo sapiens
acgttatttaatgtgagtagcaca

SEQ ID NO: 38310 - DNA, 24 bp, Homo sapiens
cacgttatttaatgtgagtagcac

SEQ ID NO: 38311 - DNA, 24 bp, Homo sapiens
gaaaacaaaaggttagaatctatt

SEQ ID NO: 38312 - DNA, 24 bp, Homo sapiens
agaaaacaaaaggttagaatctat

SEQ ID NO: 38313 - DNA, 24 bp, Homo sapiens
gagaaaacaaaaggttagaatcta

SEQ ID NO: 38314 - DNA, 24 bp, Homo sapiens
aatcttttttagtaagtagattgc

SEQ ID NO: 38315 - DNA, 24 bp, Homo sapiens
taatcttttttagtaagtagattg

SEQ ID NO: 38316 - DNA, 24 bp, Homo sapiens
ataatcttttttagtaagtagatt

SEQ ID NO: 38317 - DNA, 24 bp, Homo sapiens
gaatttgaaaggtaaaaagaattt

SEQ ID NO: 38318 - DNA, 24 bp, Homo sapiens
tgaatttgaaaggtaaaaagaatt

SEQ ID NO: 38319 - DNA, 24 bp, Homo sapiens
gtgaatttgaaaggtaaaaagaat

SEQ ID NO: 38320 - DNA, 25 bp, Homo sapiens
tctacgtcttgaacctggattcgcc

SEQ ID NO: 38321 - DNA, 23 bp, Homo sapiens
ttgggaagggctgtggacggcgt

SEQ ID NO: 38322 - DNA, 23 bp, Homo sapiens
gtagtccctggcgctgctgaccc

SEQ ID NO: 38323 - DNA, 24 bp, Homo sapiens
attgaaataaagtgaggttaaaag

SEQ ID NO: 38324 - DNA, 24 bp, Homo sapiens
tattgaaataaagtgaggttaaaa

SEQ ID NO: 38325 - DNA, 24 bp, Homo sapiens
ctattgaaataaagtgaggttaaa

SEQ ID NO: 38326 - DNA, 24 bp, Homo sapiens
aaattattgaggtaagtaattcat

SEQ ID NO: 38327 - DNA, 24 bp, Homo sapiens
aaaattattgaggtaagtaattca

SEQ ID NO: 38328 - DNA, 24 bp, Homo sapiens
caaaattattgaggtaagtaattc

SEQ ID NO: 38329 - DNA, 24 bp, Homo sapiens
gaaataaagcagtggaagaagtct

SEQ ID NO: 38330 - DNA, 24 bp, Homo sapiens
ggaaataaagcagtggaagaagtc

SEQ ID NO: 38331 - DNA, 24 bp, Homo sapiens
tggaaataaagcagtggaagaagt

SEQ ID NO: 38332 - DNA, 23 bp, Homo sapiens
tcgcaatcgcagacgctgtcaag

SEQ ID NO: 38333 - DNA, 25 bp, Homo sapiens
ccagaataaagggaagaaagtcgcc

SEQ ID NO: 38334 - DNA, 24 bp, Homo sapiens
aatgatttgctggatgtggtggct

SEQ ID NO: 38335 - DNA, 24 bp, Homo sapiens
catatgaaaaggtcatttttaata

SEQ ID NO: 38336 - DNA, 24 bp, Homo sapiens
ccatatgaaaaggtcatttttaat

SEQ ID NO: 38337 - DNA, 24 bp, Homo sapiens
accatatgaaaaggtcatttttaa

SEQ ID NO: 38338 - DNA, 24 bp, Homo sapiens
agttagaaaaggtaaaacttttac

SEQ ID NO: 38339 - DNA, 24 bp, Homo sapiens
tagttagaaaaggtaaaactttta

SEQ ID NO: 38340 - DNA, 24 bp, Homo sapiens
gtagttagaaaaggtaaaactttt

SEQ ID NO: 38341 - DNA, 24 bp, Homo sapiens
ttaaaatttaggtggtatgttttt

SEQ ID NO: 38342 - DNA, 24 bp, Homo sapiens
cttaaaatttaggtggtatgtttt

SEQ ID NO: 38343 - DNA, 24 bp, Homo sapiens
ccttaaaatttaggtggtatgttt

SEQ ID NO: 38344 - DNA, 23 bp, Homo sapiens
acactcatcaccaccgccgtctc

SEQ ID NO: 38345 - DNA, 23 bp, Homo sapiens
caccatcgccatgctgctgctca

SEQ ID NO: 38346 - DNA, 25 bp, Homo sapiens
cgctctacatcttctccaccgtcag

SEQ ID NO: 38347 - DNA, 23 bp, Homo sapiens
ctgccactgtcctccagcccgcc

SEQ ID NO: 38348 - DNA, 23 bp, Homo sapiens
accaccaccaccaccaccaccat

SEQ ID NO: 38349 - DNA, 23 bp, Homo sapiens
acgagctgccaggccaaggctgc

SEQ ID NO: 38350 - DNA, 25 bp, Homo sapiens
gtgagcaacttcccgacagtaaggc

SEQ ID NO: 38351 - DNA, 24 bp, Homo sapiens
aggctcactaagagggcaccaagt

SEQ ID NO: 38352 - DNA, 25 bp, Homo sapiens
agttcagtggtgcaatctcagctca

SEQ ID NO: 38353 - DNA, 24 bp, Homo sapiens
gtgacgtacagatgctgatcttct

SEQ ID NO: 38354 - DNA, 24 bp, Homo sapiens
tgtgacgtacagatgctgatcttc

SEQ ID NO: 38355 - DNA, 24 bp, Homo sapiens
ctgtgacgtacagatgctgatctt

SEQ ID NO: 38356 - DNA, 24 bp, Homo sapiens
ctggagaggcaggaagcaagactc

SEQ ID NO: 38357 - DNA, 24 bp, Homo sapiens
tgagcaggattacagggttggatc

SEQ ID NO: 38358 - DNA, 24 bp, Homo sapiens
actcctgaagaggtgcgacttgat

SEQ ID NO: 38359 - DNA, 24 bp, Homo sapiens
cacgataaaaggagaaaaacaagg

SEQ ID NO: 38360 - DNA, 24 bp, Homo sapiens
ccacgataaaaggagaaaaacaag

SEQ ID NO: 38361 - DNA, 24 bp, Homo sapiens
tccacgataaaaggagaaaaacaa

SEQ ID NO: 38362 - DNA, 24 bp, Homo sapiens
tacattactaagtaagtgaccaca

SEQ ID NO: 38363 - DNA, 24 bp, Homo sapiens
atacattactaagtaagtgaccac

SEQ ID NO: 38364 - DNA, 24 bp, Homo sapiens
catacattactaagtaagtgacca

SEQ ID NO: 38365 - DNA, 25 bp, Homo sapiens
acagaatgaatgagagccacaagtc

SEQ ID NO: 38366 - DNA, 23 bp, Homo sapiens
ttgggcaggctgggctcaaactc

SEQ ID NO: 38367 - DNA, 25 bp, Homo sapiens
ctgcggaagttctgaatcaagagga

SEQ ID NO: 38368 - DNA, 23 bp, Homo sapiens
agcggaggtggcagaagcaagta

SEQ ID NO: 38369 - DNA, 24 bp, Homo sapiens
ccatctgacacctatgcctacagg

SEQ ID NO: 38370 - DNA, 23 bp, Homo sapiens
gcctgtcctcaaagctccagtcc

SEQ ID NO: 38371 - DNA, 24 bp, Homo sapiens
tctcaaccttgactattatgtggc

SEQ ID NO: 38372 - DNA, 24 bp, Homo sapiens
ttctcaaccttgactattatgtgg

SEQ ID NO: 38373 - DNA, 24 bp, Homo sapiens
tttctcaaccttgactattatgtg

SEQ ID NO: 38374 - DNA, 24 bp, Homo sapiens
gaagaagagcaggtcagcagtcca

SEQ ID NO: 38375 - DNA, 24 bp, Homo sapiens
gccagagagacattaccagagcca

SEQ ID NO: 38376 - DNA, 24 bp, Homo sapiens
actgtctgcctagtgtgatgtgat

SEQ ID NO: 38377 - DNA, 24 bp, Homo sapiens
gatcgtggagggtgagtagagtct

SEQ ID NO: 38378 - DNA, 24 bp, Homo sapiens
ggatcgtggagggtgagtagagtc

SEQ ID NO: 38379 - DNA, 24 bp, Homo sapiens
gggatcgtggagggtgagtagagt

SEQ ID NO: 38380 - DNA, 24 bp, Homo sapiens
ctcaccgcaacctccgcctaccag

SEQ ID NO: 38381 - DNA, 24 bp, Homo sapiens
tcaaagaaggagagggtctcactc

SEQ ID NO: 38382 - DNA, 24 bp, Homo sapiens
ccagactggagcgcagtggcatga

SEQ ID NO: 38383 - DNA, 24 bp, Homo sapiens
aagtgaataaggtatttctatctc

SEQ ID NO: 38384 - DNA, 24 bp, Homo sapiens
gaagtgaataaggtatttctatct

SEQ ID NO: 38385 - DNA, 24 bp, Homo sapiens
agaagtgaataaggtatttctatc

SEQ ID NO: 38386 - DNA, 24 bp, Homo sapiens
gacaaggtcaaggtcctgctcaac

SEQ ID NO: 38387 - DNA, 23 bp, Homo sapiens
ggagaagccaccaccaccctgag

SEQ ID NO: 38388 - DNA, 23 bp, Homo sapiens
cccctcctgatggctctgacccc

SEQ ID NO: 38389 - DNA, 23 bp, Homo sapiens
cgtccttcatgtgttcatcgtgc

SEQ ID NO: 38390 - DNA, 25 bp, Homo sapiens
ggcgttgttgttcatcccttatcgg

SEQ ID NO: 38391 - DNA, 25 bp, Homo sapiens
aatgactgggaagaccacttggcag

SEQ ID NO: 38392 - DNA, 25 bp, Homo sapiens
aggtggtgtcagatggagatgagga

SEQ ID NO: 38393 - DNA, 25 bp, Homo sapiens
gagacttgttgaatggctttgaccc

SEQ ID NO: 38394 - DNA, 25 bp, Homo sapiens
gatagttatatagacaataaagtcc

SEQ ID NO: 38395 - DNA, 25 bp, Homo sapiens
atgaggaggatgacagtggtaagga

SEQ ID NO: 38396 - DNA, 25 bp, Homo sapiens
aatgactgggaagaccacttggcag

SEQ ID NO: 38397 - DNA, 25 bp, Homo sapiens
ggcgttgttgttcatcccttatcgg

SEQ ID NO: 38398 - DNA, 24 bp, Homo sapiens
tgatgaagaaggtaatgaaaattt

SEQ ID NO: 38399 - DNA, 24 bp, Homo sapiens
atgatgaagaaggtaatgaaaatt

SEQ ID NO: 38400 - DNA, 24 bp, Homo sapiens
tatgatgaagaaggtaatgaaaat

SEQ ID NO: 38401 - DNA, 23 bp, Homo sapiens
atcttggctcaccgcaacctccg

SEQ ID NO: 38402 - DNA, 23 bp, Homo sapiens
ccttgaggtgacagactggctct

SEQ ID NO: 38403 - DNA, 25 bp, Homo sapiens
ggtctccactcctagctgttactgc

SEQ ID NO: 38404 - DNA, 24 bp, Homo sapiens
acaaatataagggaatgaaagcta

SEQ ID NO: 38405 - DNA, 24 bp, Homo sapiens
tacaaatataagggaatgaaagct

SEQ ID NO: 38406 - DNA, 24 bp, Homo sapiens
ttacaaatataagggaatgaaagc

SEQ ID NO: 38407 - DNA, 24 bp, Homo sapiens
aaattaacaaggtaaatgtagcat

SEQ ID NO: 38408 - DNA, 24 bp, Homo sapiens
gaaattaacaaggtaaatgtagca

SEQ ID NO: 38409 - DNA, 24 bp, Homo sapiens
tgaaattaacaaggtaaatgtagc

SEQ ID NO: 38410 - DNA, 24 bp, Homo sapiens
ttggaacacacctggaaagatgcc

SEQ ID NO: 38411 - DNA, 24 bp, Homo sapiens
gctaccatctgtctgaacttgttc

SEQ ID NO: 38412 - DNA, 24 bp, Homo sapiens
cttccattagcattgcagatcact

SEQ ID NO: 38413 - DNA, 24 bp, Homo sapiens
tcttctattaggatattgtactaa

SEQ ID NO: 38414 - DNA, 24 bp, Homo sapiens
ttcttctattaggatattgtacta

SEQ ID NO: 38415 - DNA, 24 bp, Homo sapiens
tttcttctattaggatattgtact

SEQ ID NO: 38416 - DNA, 24 bp, Homo sapiens
ccagaacttcgaccttccgtacct

SEQ ID NO: 38417 - DNA, 24 bp, Homo sapiens
cttcattccagtccaagcagacgg

SEQ ID NO: 38418 - DNA, 24 bp, Homo sapiens
gcagcacagcatcatcaccgacct

SEQ ID NO: 38419 - DNA, 24 bp, Homo sapiens
gcagcactggggcagtggagtggg

SEQ ID NO: 38420 - DNA, 24 bp, Homo sapiens
agcagcactggggcagtggagtgg

SEQ ID NO: 38421 - DNA, 24 bp, Homo sapiens
cagcagcactggggcagtggagtg

SEQ ID NO: 38422 - DNA, 24 bp, Homo sapiens
gacccgttcatcttcccagagtgc

SEQ ID NO: 38423 - DNA, 24 bp, Homo sapiens
gccactgcctactccacgctccag

SEQ ID NO: 38424 - DNA, 24 bp, Homo sapiens
ccaggccaccattgatggagtcag

SEQ ID NO: 38425 - DNA, 24 bp, Homo sapiens
gagagctggatggaggcagatcgg

SEQ ID NO: 38426 - DNA, 24 bp, Homo sapiens
tcgggaagaactccagatgggaca

SEQ ID NO: 38427 - DNA, 24 bp, Homo sapiens
actgaacttgattgagaccctggt

SEQ ID NO: 38428 - DNA, 24 bp, Homo sapiens
ggctccacaaggtgagctctgagg

SEQ ID NO: 38429 - DNA, 24 bp, Homo sapiens
gggctccacaaggtgagctctgag

SEQ ID NO: 38430 - DNA, 24 bp, Homo sapiens
agggctccacaaggtgagctctga

SEQ ID NO: 38431 - DNA, 24 bp, Homo sapiens
cgggcagaaactgacctgaagacc

SEQ ID NO: 38432 - DNA, 24 bp, Homo sapiens
cacggcctcctcctggagaaggtg

SEQ ID NO: 38433 - DNA, 24 bp, Homo sapiens
ctgccaccccccaaacacaccttc

SEQ ID NO: 38434 - DNA, 24 bp, Homo sapiens
cacggtggctcatgcctgtaatcc

SEQ ID NO: 38435 - DNA, 24 bp, Homo sapiens
caccactggttaagaacaagtgcc

SEQ ID NO: 38436 - DNA, 24 bp, Homo sapiens
tctcagataactgtattttgaaaa

SEQ ID NO: 38437 - DNA, 24 bp, Homo sapiens
actatgttgctcaggctggtctcg

SEQ ID NO: 38438 - DNA, 24 bp, Homo sapiens
cataagtgttcctcctgcctcagc

SEQ ID NO: 38439 - DNA, 24 bp, Homo sapiens
aaaattgtgtagggattggtgggg

SEQ ID NO: 38440 - DNA, 24 bp, Homo sapiens
cagtaggcaccgaacccagcattt

SEQ ID NO: 38441 - DNA, 24 bp, Homo sapiens
tcactggaccgctcctagaaaggc

SEQ ID NO: 38442 - DNA, 24 bp, Homo sapiens
tcgtcacagggaataaatctcgct

SEQ ID NO: 38443 - DNA, 24 bp, Homo sapiens
agaaaagagcagtgtcgttatttg

SEQ ID NO: 38444 - DNA, 24 bp, Homo sapiens
cagaaaagagcagtgtcgttattt

SEQ ID NO: 38445 - DNA, 24 bp, Homo sapiens
gcagaaaagagcagtgtcgttatt

SEQ ID NO: 38446 - DNA, 25 bp, Homo sapiens
tgctacacatactcacaacgctgcc

SEQ ID NO: 38447 - DNA, 25 bp, Homo sapiens
agaagaggaggaagtgggagatgcg

SEQ ID NO: 38448 - DNA, 24 bp, Homo sapiens
aactcctactactgctgggctggg

SEQ ID NO: 38449 - DNA, 23 bp, Homo sapiens
ctactgctgggctgggctgggct

SEQ ID NO: 38450 - DNA, 23 bp, Homo sapiens
tgcagccgctgctacacatactc

SEQ ID NO: 38451 - DNA, 23 bp, Homo sapiens
ggctgcgccggagctcgcctgca

SEQ ID NO: 38452 - DNA, 23 bp, Homo sapiens
gcgggaaagcgtggcaaagacat

SEQ ID NO: 38453 - DNA, 25 bp, Homo sapiens
ggcaacttgatctcatcgctggtat

SEQ ID NO: 38454 - DNA, 23 bp, Homo sapiens
ccaccacaaccaccaacagcacc

SEQ ID NO: 38455 - DNA, 24 bp, Homo sapiens
cactgtgagagcctgtcagtccct

SEQ ID NO: 38456 - DNA, 24 bp, Homo sapiens
ccactgtgagagcctgtcagtccc

SEQ ID NO: 38457 - DNA, 24 bp, Homo sapiens
gccactgtgagagcctgtcagtcc

SEQ ID NO: 38458 - DNA, 24 bp, Homo sapiens
tggttttattggtaagttttagaa

SEQ ID NO: 38459 - DNA, 24 bp, Homo sapiens
ttggttttattggtaagttttaga

SEQ ID NO: 38460 - DNA, 24 bp, Homo sapiens
tttggttttattggtaagttttag

SEQ ID NO: 38461 - DNA, 24 bp, Homo sapiens
gctctttttatggtctttattata

SEQ ID NO: 38462 - DNA, 24 bp, Homo sapiens
tgctctttttatggtctttattat

SEQ ID NO: 38463 - DNA, 24 bp, Homo sapiens
ttgctctttttatggtctttatta

SEQ ID NO: 38464 - DNA, 25 bp, Homo sapiens
agttaccttccacgctgtatgtccg

SEQ ID NO: 38465 - DNA, 23 bp, Homo sapiens
gctcaagtgatcctcctgcctca

SEQ ID NO: 38466 - DNA, 23 bp, Homo sapiens
cggttgctctctcagaatctcgc

SEQ ID NO: 38467 - DNA, 24 bp, Homo sapiens
ttatgattttggtatttatgatga

SEQ ID NO: 38468 - DNA, 24 bp, Homo sapiens
gttatgattttggtatttatgatg

SEQ ID NO: 38469 - DNA, 24 bp, Homo sapiens
cgttatgattttggtatttatgat

SEQ ID NO: 38470 - DNA, 24 bp, Homo sapiens
atagcttggagtgtgttcaaggga

SEQ ID NO: 38471 - DNA, 23 bp, Homo sapiens
gtggtcttatcagagaaatatgt

SEQ ID NO: 38472 - DNA, 25 bp, Homo sapiens
atcaaatactttaaatgtctggttt

SEQ ID NO: 38473 - DNA, 23 bp, Homo sapiens
cgaatccaccagcacgagcgtcc

SEQ ID NO: 38474 - DNA, 23 bp, Homo sapiens
tgggaccatggccactgactcat

SEQ ID NO: 38475 - DNA, 23 bp, Homo sapiens
acccccggagcccacgatccctc

SEQ ID NO: 38476 - DNA, 23 bp, Homo sapiens
cattgccactgatgcttgctgag

SEQ ID NO: 38477 - DNA, 24 bp, Homo sapiens
tttagggcaagtgtggtggctcat

SEQ ID NO: 38478 - DNA, 23 bp, Homo sapiens
ccgaggcaggcagatcgcttgag

SEQ ID NO: 38479 - DNA, 23 bp, Homo sapiens
aagagaccacagacctcctcgcc

SEQ ID NO: 38480 - DNA, 23 bp, Homo sapiens
gcctccacagtcatagcctatgc

SEQ ID NO: 38481 - DNA, 25 bp, Homo sapiens
gctgtctgagtatgaaggcatcttg

SEQ ID NO: 38482 - DNA, 23 bp, Homo sapiens
ctgggctgtgtggctgtcctgag

SEQ ID NO: 38483 - DNA, 23 bp, Homo sapiens
aatgtgcaccttcttgcctggac

SEQ ID NO: 38484 - DNA, 23 bp, Homo sapiens
ctgtggccctgcagcaggtggtg

SEQ ID NO: 38485 - DNA, 24 bp, Homo sapiens
cttctgcctaatttgaatgatatt

SEQ ID NO: 38486 - DNA, 24 bp, Homo sapiens
acttctgcctaatttgaatgatat

SEQ ID NO: 38487 - DNA, 24 bp, Homo sapiens
aacttctgcctaatttgaatgata

SEQ ID NO: 38488 - DNA, 23 bp, Homo sapiens
ctgcatgtactggctccccaaca

SEQ ID NO: 38489 - DNA, 23 bp, Homo sapiens
gcaggagcggcggcccagcactt

SEQ ID NO: 38490 - DNA, 23 bp, Homo sapiens
gtctgcgcccctctccgtgtgga

SEQ ID NO: 38491 - DNA, 24 bp, Homo sapiens
tatttatgtagaaactgctggagc

SEQ ID NO: 38492 - DNA, 24 bp, Homo sapiens
ttatttatgtagaaactgctggag

SEQ ID NO: 38493 - DNA, 24 bp, Homo sapiens
tttatttatgtagaaactgctgga

SEQ ID NO: 38494 - DNA, 24 bp, Homo sapiens
ctttgtaacagaaatcgacttaaa

SEQ ID NO: 38495 - DNA, 24 bp, Homo sapiens
tctttgtaacagaaatcgacttaa

SEQ ID NO: 38496 - DNA, 24 bp, Homo sapiens
ttctttgtaacagaaatcgactta

SEQ ID NO: 38497 - DNA, 23 bp, Homo sapiens
tggtggctattccgaggaagagg

SEQ ID NO: 38498 - DNA, 23 bp, Homo sapiens
aacaggctcagcatcttggaccg

SEQ ID NO: 38499 - DNA, 23 bp, Homo sapiens
tgagtgaggaggaggcagcagag

SEQ ID NO: 38500 - DNA, 23 bp, Homo sapiens
ccctgtccctggctccctcatta

SEQ ID NO: 38501 - DNA, 23 bp, Homo sapiens
ttgagtggaggaagatggcggct

SEQ ID NO: 38502 - DNA, 23 bp, Homo sapiens
ccagcggagcgaacccgagagcg

SEQ ID NO: 38503 - DNA, 24 bp, Homo sapiens
ataatttctagaataggaaaacaa

SEQ ID NO: 38504 - DNA, 24 bp, Homo sapiens
gataatttctagaataggaaaaca

SEQ ID NO: 38505 - DNA, 24 bp, Homo sapiens
tgataatttctagaataggaaaac

SEQ ID NO: 38506 - DNA, 23 bp, Homo sapiens
ctcaccgcaacctccgccttctg

SEQ ID NO: 38507 - DNA, 25 bp, Homo sapiens
aggttctgatggcttctcccgatgt

SEQ ID NO: 38508 - DNA, 24 bp, Homo sapiens
atgccctcaccgttcctttctcct

SEQ ID NO: 38509 - DNA, 23 bp, Homo sapiens
acgaggctgggcaggcaagtgag

SEQ ID NO: 38510 - DNA, 23 bp, Homo sapiens
gcctcattcctctggggctgatg

SEQ ID NO: 38511 - DNA, 23 bp, Homo sapiens
agttgggcacttcactcacgtgt

SEQ ID NO: 38512 - DNA, 24 bp, Homo sapiens
aaaatgagaagctcatttccctac

SEQ ID NO: 38513 - DNA, 24 bp, Homo sapiens
aaaaatgagaagctcatttcccta

SEQ ID NO: 38514 - DNA, 24 bp, Homo sapiens
aaaaaatgagaagctcatttccct

SEQ ID NO: 38515 - DNA, 24 bp, Homo sapiens
cacaaaaaaaggttagttacatgc

SEQ ID NO: 38516 - DNA, 24 bp, Homo sapiens
acacaaaaaaaggttagttacatg

SEQ ID NO: 38517 - DNA, 24 bp, Homo sapiens
aacacaaaaaaaggttagttacat

SEQ ID NO: 38518 - DNA, 25 bp, Homo sapiens
ttatattgcgtctgcctctggaaca

SEQ ID NO: 38519 - DNA, 25 bp, Homo sapiens
gcagttgttgaagtagaagatgtcc

SEQ ID NO: 38520 - DNA, 25 bp, Homo sapiens
gctggttgacttgccttgtgttatt

SEQ ID NO: 38521 - DNA, 25 bp, Homo sapiens
ctgaagaagtgaggagagccattgg

SEQ ID NO: 38522 - DNA, 25 bp, Homo sapiens
ttgtcccttcagttgccttatgttg

SEQ ID NO: 38523 - DNA, 25 bp, Homo sapiens
ggtcttgttatgttgcccaggctga

SEQ ID NO: 38524 - DNA, 24 bp, Homo sapiens
agggcacaagcactagaaatcagt

SEQ ID NO: 38525 - DNA, 24 bp, Homo sapiens
aagaattatttaatccacatggga

SEQ ID NO: 38526 - DNA, 24 bp, Homo sapiens
cttcttgatggatctgaatgaaca

SEQ ID NO: 38527 - DNA, 23 bp, Homo sapiens
cagaggtggagtggacaggagca

SEQ ID NO: 38528 - DNA, 25 bp, Homo sapiens
gtggagtgtgacaatatgaaccgct

SEQ ID NO: 38529 - DNA, 25 bp, Homo sapiens
tgcttgatgtggatctgcctgagga

SEQ ID NO: 38530 - DNA, 25 bp, Homo sapiens
tgtcattgccatccagtccagaacc

SEQ ID NO: 38531 - DNA, 25 bp, Homo sapiens
tggtgataaagtatataagaatgaa

SEQ ID NO: 38532 - DNA, 25 bp, Homo sapiens
aaacaacttaaagacgaaataaaga

SEQ ID NO: 38533 - DNA, 23 bp, Homo sapiens
cagagcggcagcagcaggaggag

SEQ ID NO: 38534 - DNA, 23 bp, Homo sapiens
gacgagctgctgagctggaagag

SEQ ID NO: 38535 - DNA, 23 bp, Homo sapiens
cggtaacctggctgctcggggag

SEQ ID NO: 38536 - DNA, 24 bp, Homo sapiens
tattgtaacagctaatagagaagc

SEQ ID NO: 38537 - DNA, 24 bp, Homo sapiens
ctattgtaacagctaatagagaag

SEQ ID NO: 38538 - DNA, 24 bp, Homo sapiens
cctattgtaacagctaatagagaa

SEQ ID NO: 38539 - DNA, 24 bp, Homo sapiens
ggagaaactaactacctgagaaga

SEQ ID NO: 38540 - DNA, 24 bp, Homo sapiens
tggagaaactaactacctgagaag

SEQ ID NO: 38541 - DNA, 24 bp, Homo sapiens
atggagaaactaactacctgagaa

SEQ ID NO: 38542 - DNA, 25 bp, Homo sapiens
tgaaaccgctctcgtaatttgccac

SEQ ID NO: 38543 - DNA, 25 bp, Homo sapiens
tgaatgaacacagaatcagcatggc

SEQ ID NO: 38544 - DNA, 24 bp, Homo sapiens
tctcctcgaagatgctgatggtgg

SEQ ID NO: 38545 - DNA, 24 bp, Homo sapiens
atgcagcccagccctgtatcaaat

SEQ ID NO: 38546 - DNA, 24 bp, Homo sapiens
tatgcagcccagccctgtatcaaa

SEQ ID NO: 38547 - DNA, 24 bp, Homo sapiens
ctatgcagcccagccctgtatcaa

SEQ ID NO: 38548 - DNA, 24 bp, Homo sapiens
ccaggcaacttcctcaccagtacg

SEQ ID NO: 38549 - DNA, 24 bp, Homo sapiens
agtcctggagctgagagtgagaag

SEQ ID NO: 38550 - DNA, 24 bp, Homo sapiens
gggtgtccaggagcactttgaggc

SEQ ID NO: 38551 - DNA, 24 bp, Homo sapiens
cagtgaggcagtcatttctgtggc

SEQ ID NO: 38552 - DNA, 23 bp, Homo sapiens
ccacaggctatcttcagagtccg

SEQ ID NO: 38553 - DNA, 23 bp, Homo sapiens
caggcagtggagacagagaaggt

SEQ ID NO: 38554 - DNA, 24 bp, Homo sapiens
tttataaacaggacagtactggca

SEQ ID NO: 38555 - DNA, 24 bp, Homo sapiens
ctttataaacaggacagtactggc

SEQ ID NO: 38556 - DNA, 24 bp, Homo sapiens
gctttataaacaggacagtactgg

SEQ ID NO: 38557 - DNA, 25 bp, Homo sapiens
tcacaggacaaccatcacaggacaa

SEQ ID NO: 38558 - DNA, 23 bp, Homo sapiens
cctgtaggcagaacttcacgagc

SEQ ID NO: 38559 - DNA, 23 bp, Homo sapiens
cggttgtcagacgaggttggctt

SEQ ID NO: 38560 - DNA, 25 bp, Homo sapiens
tgccaagttaagccgattatgtgaa

SEQ ID NO: 38561 - DNA, 25 bp, Homo sapiens
tcagccagccaagagatagaaatgc

SEQ ID NO: 38562 - DNA, 24 bp, Homo sapiens
cagcagccattcagacagtggtgt

SEQ ID NO: 38563 - DNA, 24 bp, Homo sapiens
gggtggagcaggtgtttacagtcg

SEQ ID NO: 38564 - DNA, 23 bp, Homo sapiens
aggctctgaggaccgtgctgaag

SEQ ID NO: 38565 - DNA, 25 bp, Homo sapiens
caatgaccaggacagaactgatcgg

SEQ ID NO: 38566 - DNA, 24 bp, Homo sapiens
tattgttatagattacaaatgttg

SEQ ID NO: 38567 - DNA, 24 bp, Homo sapiens
ttattgttatagattacaaatgtt

SEQ ID NO: 38568 - DNA, 24 bp, Homo sapiens
cttattgttatagattacaaatgt

SEQ ID NO: 38569 - DNA, 24 bp, Homo sapiens
aaacactctaaatgaagatgatat

SEQ ID NO: 38570 - DNA, 24 bp, Homo sapiens
gaaacactctaaatgaagatgata

SEQ ID NO: 38571 - DNA, 24 bp, Homo sapiens
agaaacactctaaatgaagatgat

SEQ ID NO: 38572 - DNA, 24 bp, Homo sapiens
ttgaagaccagattacaaatgttg

SEQ ID NO: 38573 - DNA, 24 bp, Homo sapiens
attgaagaccagattacaaatgtt

SEQ ID NO: 38574 - DNA, 24 bp, Homo sapiens
aattgaagaccagattacaaatgt

SEQ ID NO: 38575 - DNA, 25 bp, Homo sapiens
aatcctcccactgtagcctcccaag

SEQ ID NO: 38576 - DNA, 23 bp, Homo sapiens
gcccaggctggagcacagtgacg

SEQ ID NO: 38577 - DNA, 23 bp, Homo sapiens
gcccactgcagcctcaaactcct

SEQ ID NO: 38578 - DNA, 24 bp, Homo sapiens
ataaaaatcaggtatgctaatatg

SEQ ID NO: 38579 - DNA, 24 bp, Homo sapiens
tataaaaatcaggtatgctaatat

SEQ ID NO: 38580 - DNA, 24 bp, Homo sapiens
gtataaaaatcaggtatgctaata

SEQ ID NO: 38581 - DNA, 24 bp, Homo sapiens
tatattgtgagattgcacatgtta

SEQ ID NO: 38582 - DNA, 24 bp, Homo sapiens
atatattgtgagattgcacatgtt

SEQ ID NO: 38583 - DNA, 24 bp, Homo sapiens
aatatattgtgagattgcacatgt

SEQ ID NO: 38584 - DNA, 24 bp, Homo sapiens
aatacagaaaggaaaaactgataa

SEQ ID NO: 38585 - DNA, 24 bp, Homo sapiens
gaatacagaaaggaaaaactgata

SEQ ID NO: 38586 - DNA, 24 bp, Homo sapiens
ggaatacagaaaggaaaaactgat

SEQ ID NO: 38587 - DNA, 24 bp, Homo sapiens
ttttcaataagtgtcttaaagact

SEQ ID NO: 38588 - DNA, 24 bp, Homo sapiens
cttttcaataagtgtcttaaagac

SEQ ID NO: 38589 - DNA, 24 bp, Homo sapiens
tcttttcaataagtgtcttaaaga

SEQ ID NO: 38590 - DNA, 24 bp, Homo sapiens
catcatgtcttgtgagttttttca

SEQ ID NO: 38591 - DNA, 24 bp, Homo sapiens
acatcatgtcttgtgagttttttc

SEQ ID NO: 38592 - DNA, 24 bp, Homo sapiens
tacatcatgtcttgtgagtttttt

SEQ ID NO: 38593 - DNA, 24 bp, Homo sapiens
gcactcaagaatgattatccaggc

SEQ ID NO: 38594 - DNA, 25 bp, Homo sapiens
aggtcaggtttagggtagattggga

SEQ ID NO: 38595 - DNA, 23 bp, Homo sapiens
ccaggcaggcagatcatgaggtc

SEQ ID NO: 38596 - DNA, 25 bp, Homo sapiens
gctcatgcctgtaatcccagcactt

SEQ ID NO: 38597 - DNA, 23 bp, Homo sapiens
aagaatgattatccaggccgggt

SEQ ID NO: 38598 - DNA, 24 bp, Homo sapiens
ataattataaggtaagagagctac

SEQ ID NO: 38599 - DNA, 24 bp, Homo sapiens
aataattataaggtaagagagcta

SEQ ID NO: 38600 - DNA, 24 bp, Homo sapiens
gaataattataaggtaagagagct

SEQ ID NO: 38601 - DNA, 24 bp, Homo sapiens
gagtcaggaagattgttttagcaa

SEQ ID NO: 38602 - DNA, 24 bp, Homo sapiens
ggagtcaggaagattgttttagca

SEQ ID NO: 38603 - DNA, 24 bp, Homo sapiens
aggagtcaggaagattgttttagc

SEQ ID NO: 38604 - DNA, 24 bp, Homo sapiens
agaagagaaagataaaaagaaaga

SEQ ID NO: 38605 - DNA, 24 bp, Homo sapiens
aagaagagaaagataaaaagaaag

SEQ ID NO: 38606 - DNA, 24 bp, Homo sapiens
gaagaagagaaagataaaaagaaa

SEQ ID NO: 38607 - DNA, 25 bp, Homo sapiens
ttaccaggacttgctcatattcagc

SEQ ID NO: 38608 - DNA, 23 bp, Homo sapiens
gtacagcagccgcactcagcatg

SEQ ID NO: 38609 - DNA, 25 bp, Homo sapiens
tctggaagaggaagaagaagtaacc

SEQ ID NO: 38610 - DNA, 24 bp, Homo sapiens
cccaaagcaagaagccagtgtcca

SEQ ID NO: 38611 - DNA, 23 bp, Homo sapiens
aaatctgccgaggctggaattgc

SEQ ID NO: 38612 - DNA, 23 bp, Homo sapiens
ccaccgctgccgctgccgctgcc

SEQ ID NO: 38613 - DNA, 24 bp, Homo sapiens
cctggagcccatgttctcgctcct

SEQ ID NO: 38614 - DNA, 24 bp, Homo sapiens
ccctggagcccatgttctcgctcc

SEQ ID NO: 38615 - DNA, 24 bp, Homo sapiens
gccctggagcccatgttctcgctc

SEQ ID NO: 38616 - DNA, 24 bp, Homo sapiens
acatctccatcaggtccaactcgc

SEQ ID NO: 38617 - DNA, 24 bp, Homo sapiens
gtaggaggagcaatctcaacagcc

SEQ ID NO: 38618 - DNA, 24 bp, Homo sapiens
attcgcagcagccaagccagcctt

SEQ ID NO: 38619 - DNA, 25 bp, Homo sapiens
actggcttgtctgtaatagaagtga

SEQ ID NO: 38620 - DNA, 25 bp, Homo sapiens
agttcgctatcctgtccttactcct

SEQ ID NO: 38621 - DNA, 23 bp, Homo sapiens
tcaccatgctgttgctgctggag

SEQ ID NO: 38622 - DNA, 25 bp, Homo sapiens
agttcgctatcctgtccttactcct

SEQ ID NO: 38623 - DNA, 23 bp, Homo sapiens
tcaccatgctgttgctgctggag

SEQ ID NO: 38624 - DNA, 24 bp, Homo sapiens
gggtatgtgtcttgtgctctgggc

SEQ ID NO: 38625 - DNA, 24 bp, Homo sapiens
caaagagacaggagttacctaaaa

SEQ ID NO: 38626 - DNA, 24 bp, Homo sapiens
tcaaagagacaggagttacctaaa

SEQ ID NO: 38627 - DNA, 24 bp, Homo sapiens
ttcaaagagacaggagttacctaa

SEQ ID NO: 38628 - DNA, 24 bp, Homo sapiens
acattaaacaggttaaaaataaat

SEQ ID NO: 38629 - DNA, 24 bp, Homo sapiens
gacattaaacaggttaaaaataaa

SEQ ID NO: 38630 - DNA, 24 bp, Homo sapiens
tgacattaaacaggttaaaaataa

SEQ ID NO: 38631 - DNA, 25 bp, Homo sapiens
actctgtggtatcgtggcaaggtga

SEQ ID NO: 38632 - DNA, 25 bp, Homo sapiens
aggagaagcatgtgcagtaagagga

SEQ ID NO: 38633 - DNA, 25 bp, Homo sapiens
gctgtgttggtgatgatggaactat

SEQ ID NO: 38634 - DNA, 25 bp, Homo sapiens
tgatgatggcttatggtatagagcg

SEQ ID NO: 38635 - DNA, 25 bp, Homo sapiens
agtacaatttgttgattatggatca

SEQ ID NO: 38636 - DNA, 25 bp, Homo sapiens
gttgccattaaagaatttaatcctt

SEQ ID NO: 38637 - DNA, 25 bp, Homo sapiens
cgattctcttggtgctcctgaaatg

SEQ ID NO: 38638 - DNA, 25 bp, Homo sapiens
gcgaagaggccagatcatcagaatg

SEQ ID NO: 38639 - DNA, 25 bp, Homo sapiens
cactgtgctgttaagatccaagata

SEQ ID NO: 38640 - DNA, 24 bp, Homo sapiens
gaaattcaaaggttaagttttttt

SEQ ID NO: 38641 - DNA, 24 bp, Homo sapiens
ggaaattcaaaggttaagtttttt

SEQ ID NO: 38642 - DNA, 24 bp, Homo sapiens
aggaaattcaaaggttaagttttt

SEQ ID NO: 38643 - DNA, 24 bp, Homo sapiens
gaaaaattcagattggaagtaaag

SEQ ID NO: 38644 - DNA, 24 bp, Homo sapiens
agaaaaattcagattggaagtaaa

SEQ ID NO: 38645 - DNA, 24 bp, Homo sapiens
tagaaaaattcagattggaagtaa

SEQ ID NO: 38646 - DNA, 24 bp, Homo sapiens
ggagccacagccacctatattgag

SEQ ID NO: 38647 - DNA, 25 bp, Homo sapiens
atgatgtggtaatgcccttgcctgg

SEQ ID NO: 38648 - DNA, 25 bp, Homo sapiens
attcaagaagcctacagggaaatgc

SEQ ID NO: 38649 - DNA, 24 bp, Homo sapiens
gtagaatgaagatggaaaagaaaa

SEQ ID NO: 38650 - DNA, 24 bp, Homo sapiens
agtagaatgaagatggaaaagaaa

SEQ ID NO: 38651 - DNA, 24 bp, Homo sapiens
aagtagaatgaagatggaaaagaa

SEQ ID NO: 38652 - DNA, 24 bp, Homo sapiens
ggtcaaaaaatgtaagtttttcta

SEQ ID NO: 38653 - DNA, 24 bp, Homo sapiens
aggtcaaaaaatgtaagtttttct

SEQ ID NO: 38654 - DNA, 24 bp, Homo sapiens
taggtcaaaaaatgtaagtttttc

SEQ ID NO: 38655 - DNA, 24 bp, Homo sapiens
tagagatgaagtgtttcatactga

SEQ ID NO: 38656 - DNA, 24 bp, Homo sapiens
ttagagatgaagtgtttcatactg

SEQ ID NO: 38657 - DNA, 24 bp, Homo sapiens
gttagagatgaagtgtttcatact

SEQ ID NO: 38658 - DNA, 24 bp, Homo sapiens
aaacagaaaactgtttcatactga

SEQ ID NO: 38659 - DNA, 24 bp, Homo sapiens
aaaacagaaaactgtttcatactg

SEQ ID NO: 38660 - DNA, 24 bp, Homo sapiens
taaaacagaaaactgtttcatact

SEQ ID NO: 38661 - DNA, 23 bp, Homo sapiens
aagatgttgctgctgctgctgct

SEQ ID NO: 38662 - DNA, 25 bp, Homo sapiens
catgtcagtgtaccagatcgaatca

SEQ ID NO: 38663 - DNA, 25 bp, Homo sapiens
gggcgggactaaaggaactacaagc

SEQ ID NO: 38664 - DNA, 25 bp, Homo sapiens
ggaacatagatggctgaagacagaa

SEQ ID NO: 38665 - DNA, 25 bp, Homo sapiens
aggagcagcagggaccatagaaact

SEQ ID NO: 38666 - DNA, 25 bp, Homo sapiens
catggagagaactctggagatggcg

SEQ ID NO: 38667 - DNA, 24 bp, Homo sapiens
tcgtcgctccttgctctcctggga

SEQ ID NO: 38668 - DNA, 24 bp, Homo sapiens
gtcgtcgctccttgctctcctggg

SEQ ID NO: 38669 - DNA, 24 bp, Homo sapiens
tgtcgtcgctccttgctctcctgg

SEQ ID NO: 38670 - DNA, 24 bp, Homo sapiens
tgatgcctagccagttggtaagcc

SEQ ID NO: 38671 - DNA, 23 bp, Homo sapiens
agaactactgcgcctggcctaca

SEQ ID NO: 38672 - DNA, 23 bp, Homo sapiens
tgcgtggagcagggcaagagctg

SEQ ID NO: 38673 - DNA, 24 bp, Homo sapiens
tttctctccagtaaaattggttct

SEQ ID NO: 38674 - DNA, 24 bp, Homo sapiens
ttttctctccagtaaaattggttc

SEQ ID NO: 38675 - DNA, 24 bp, Homo sapiens
attttctctccagtaaaattggtt

SEQ ID NO: 38676 - DNA, 24 bp, Homo sapiens
aaaaaaaaaaacctactttgggga

SEQ ID NO: 38677 - DNA, 24 bp, Homo sapiens
aaaaaaaaaaaacctactttgggg

SEQ ID NO: 38678 - DNA, 24 bp, Homo sapiens
caaaaaaaaaaaacctactttggg

SEQ ID NO: 38679 - DNA, 23 bp, Homo sapiens
gctggcatagcaagtccactgac

SEQ ID NO: 38680 - DNA, 25 bp, Homo sapiens
gccactctgagcaaactcttggaaa

SEQ ID NO: 38681 - DNA, 23 bp, Homo sapiens
gacgagagacaccacagccagca

SEQ ID NO: 38682 - DNA, 24 bp, Homo sapiens
ccccgtggatggagtcagcaagat

SEQ ID NO: 38683 - DNA, 24 bp, Homo sapiens
gccccgtggatggagtcagcaaga

SEQ ID NO: 38684 - DNA, 24 bp, Homo sapiens
agccccgtggatggagtcagcaag

SEQ ID NO: 38685 - DNA, 24 bp, Homo sapiens
taggactacagaaaataaaaagcc

SEQ ID NO: 38686 - DNA, 24 bp, Homo sapiens
ctaggactacagaaaataaaaagc

SEQ ID NO: 38687 - DNA, 24 bp, Homo sapiens
gctaggactacagaaaataaaaag

SEQ ID NO: 38688 - DNA, 24 bp, Homo sapiens
tccagtggaaaaaaggaaatataa

SEQ ID NO: 38689 - DNA, 24 bp, Homo sapiens
ctccagtggaaaaaaggaaatata

SEQ ID NO: 38690 - DNA, 24 bp, Homo sapiens
actccagtggaaaaaaggaaatat

SEQ ID NO: 38691 - DNA, 24 bp, Homo sapiens
tgattagacatatcattctcatct

SEQ ID NO: 38692 - DNA, 24 bp, Homo sapiens
gtgattagacatatcattctcatc

SEQ ID NO: 38693 - DNA, 24 bp, Homo sapiens
tgtgattagacatatcattctcat

SEQ ID NO: 38694 - DNA, 23 bp, Homo sapiens
gcctccagttcctcgactctgcc

SEQ ID NO: 38695 - DNA, 25 bp, Homo sapiens
agattgtgtaccacttggaccttgt

SEQ ID NO: 38696 - DNA, 23 bp, Homo sapiens
gaagtgagcgtggacctgccgaa

SEQ ID NO: 38697 - DNA, 25 bp, Homo sapiens
ccaggcggaactctcctatctgaat

SEQ ID NO: 38698 - DNA, 23 bp, Homo sapiens
aatcagacagaagcaatggaatt

SEQ ID NO: 38699 - DNA, 24 bp, Homo sapiens
ttacaactcaggcatgacattctt

SEQ ID NO: 38700 - DNA, 25 bp, Homo sapiens
accacgtactggctagacttatact

SEQ ID NO: 38701 - DNA, 24 bp, Homo sapiens
aggctttctgactcctgctctagg

SEQ ID NO: 38702 - DNA, 23 bp, Homo sapiens
cagatgggtggctgggccagaag

SEQ ID NO: 38703 - DNA, 23 bp, Homo sapiens
tttgtcctccgaggcacccagtc

SEQ ID NO: 38704 - DNA, 23 bp, Homo sapiens
gcacttctgcgaaggagcccagg

SEQ ID NO: 38705 - DNA, 23 bp, Homo sapiens
cctgcccgccgccacctccagac

SEQ ID NO: 38706 - DNA, 23 bp, Homo sapiens
gagccgagcccacttcttccagc

SEQ ID NO: 38707 - DNA, 25 bp, Homo sapiens
atcctgctactggtcactgtcctcc

SEQ ID NO: 38708 - DNA, 25 bp, Homo sapiens
accagaagtcgggaaagtcaaaggg

SEQ ID NO: 38709 - DNA, 24 bp, Homo sapiens
tcaagtagatggtgttcagtttat

SEQ ID NO: 38710 - DNA, 24 bp, Homo sapiens
atcaagtagatggtgttcagttta

SEQ ID NO: 38711 - DNA, 24 bp, Homo sapiens
catcaagtagatggtgttcagttt

SEQ ID NO: 38712 - DNA, 24 bp, Homo sapiens
agactttacaggtggtaagttttc

SEQ ID NO: 38713 - DNA, 24 bp, Homo sapiens
aagactttacaggtggtaagtttt

SEQ ID NO: 38714 - DNA, 24 bp, Homo sapiens
taagactttacaggtggtaagttt

SEQ ID NO: 38715 - DNA, 24 bp, Homo sapiens
tttgtttttagaaagaagaaaaaa

SEQ ID NO: 38716 - DNA, 24 bp, Homo sapiens
gtttgtttttagaaagaagaaaaa

SEQ ID NO: 38717 - DNA, 24 bp, Homo sapiens
tgtttgtttttagaaagaagaaaa

SEQ ID NO: 38718 - DNA, 24 bp, Homo sapiens
ggattgctgctgtgagtctgtgaa

SEQ ID NO: 38719 - DNA, 25 bp, Homo sapiens
ccaccaagtgtccaataacaaccaa

SEQ ID NO: 38720 - DNA, 23 bp, Homo sapiens
tgagagggagcgtgagcgagaaa

SEQ ID NO: 38721 - DNA, 24 bp, Homo sapiens
aaatacaacttcttcttaatgaag

SEQ ID NO: 38722 - DNA, 24 bp, Homo sapiens
aaaatacaacttcttcttaatgaa

SEQ ID NO: 38723 - DNA, 24 bp, Homo sapiens
gaaaatacaacttcttcttaatga

SEQ ID NO: 38724 - DNA, 24 bp, Homo sapiens
gccgcttatgctattccgatgctg

SEQ ID NO: 38725 - DNA, 23 bp, Homo sapiens
ggctccttcaggctgtcaccgat

SEQ ID NO: 38726 - DNA, 24 bp, Homo sapiens
cgtctccgaagccgattggttgtt

SEQ ID NO: 38727 - DNA, 24 bp, Homo sapiens
ggaggattatgatagtaaccattt

SEQ ID NO: 38728 - DNA, 24 bp, Homo sapiens
aggaggattatgatagtaaccatt

SEQ ID NO: 38729 - DNA, 24 bp, Homo sapiens
caggaggattatgatagtaaccat

SEQ ID NO: 38730 - DNA, 23 bp, Homo sapiens
gccagcaaccagtgagtgacctt

SEQ ID NO: 38731 - DNA, 23 bp, Homo sapiens
agcgaggacctgagaccgtagcc

SEQ ID NO: 38732 - DNA, 25 bp, Homo sapiens
cttgagcccaggagtttgagaccat

SEQ ID NO: 38733 - DNA, 23 bp, Homo sapiens
ctcttggtggcggctgctgttcc

SEQ ID NO: 38734 - DNA, 23 bp, Homo sapiens
ctggagcacctgtggcggagagc

SEQ ID NO: 38735 - DNA, 23 bp, Homo sapiens
cctgccgactgcttgggaccttg

SEQ ID NO: 38736 - DNA, 25 bp, Homo sapiens
tgtggactcaacagtttgtggcaag

SEQ ID NO: 38737 - DNA, 23 bp, Homo sapiens
gtcaccacagttctggaggctgg

SEQ ID NO: 38738 - DNA, 25 bp, Homo sapiens
agtgccagcagattcagtgtcatgt

SEQ ID NO: 38739 - DNA, 24 bp, Homo sapiens
gttgcttttaagaatatatggacc

SEQ ID NO: 38740 - DNA, 24 bp, Homo sapiens
tgttgcttttaagaatatatggac

SEQ ID NO: 38741 - DNA, 24 bp, Homo sapiens
atgttgcttttaagaatatatgga

SEQ ID NO: 38742 - DNA, 25 bp, Homo sapiens
agtgccagcagattcagtgtcatgt

SEQ ID NO: 38743 - DNA, 23 bp, Homo sapiens
gtcaccacagttctggaggctgg

SEQ ID NO: 38744 - DNA, 24 bp, Homo sapiens
cctgtctgctctgtggactcaaca

SEQ ID NO: 38745 - DNA, 24 bp, Homo sapiens
gttcagacccagacgatgccagag

SEQ ID NO: 38746 - DNA, 23 bp, Homo sapiens
atggagcagccacaggaggaagc

SEQ ID NO: 38747 - DNA, 23 bp, Homo sapiens
gaagtggcagaggcagaaggagc

SEQ ID NO: 38748 - DNA, 24 bp, Homo sapiens
cccccagcctgtatgaaaacccat

SEQ ID NO: 38749 - DNA, 24 bp, Homo sapiens
acccccagcctgtatgaaaaccca

SEQ ID NO: 38750 - DNA, 24 bp, Homo sapiens
cacccccagcctgtatgaaaaccc

SEQ ID NO: 38751 - DNA, 24 bp, Homo sapiens
taacagatttgttggatggattta

SEQ ID NO: 38752 - DNA, 24 bp, Homo sapiens
ctaacagatttgttggatggattt

SEQ ID NO: 38753 - DNA, 24 bp, Homo sapiens
actaacagatttgttggatggatt

SEQ ID NO: 38754 - DNA, 23 bp, Homo sapiens
gatcggccagcggaaccactgtt

SEQ ID NO: 38755 - DNA, 23 bp, Homo sapiens
ctgccgcccgtgccctgctgctt

SEQ ID NO: 38756 - DNA, 23 bp, Homo sapiens
ctggccgaacgctggaggctgcg

SEQ ID NO: 38757 - DNA, 24 bp, Homo sapiens
atctcagggaggcatctgatctac

SEQ ID NO: 38758 - DNA, 24 bp, Homo sapiens
tatctcagggaggcatctgatcta

SEQ ID NO: 38759 - DNA, 24 bp, Homo sapiens
gtatctcagggaggcatctgatct

SEQ ID NO: 38760 - DNA, 24 bp, Homo sapiens
aaagaaattgggtatttgttgtta

SEQ ID NO: 38761 - DNA, 24 bp, Homo sapiens
aaaagaaattgggtatttgttgtt

SEQ ID NO: 38762 - DNA, 24 bp, Homo sapiens
aaaaagaaattgggtatttgttgt

SEQ ID NO: 38763 - DNA, 24 bp, Homo sapiens
gagcttctcagacaactgacatat

SEQ ID NO: 38764 - DNA, 24 bp, Homo sapiens
agagcttctcagacaactgacata

SEQ ID NO: 38765 - DNA, 24 bp, Homo sapiens
cagagcttctcagacaactgacat

SEQ ID NO: 38766 - DNA, 25 bp, Homo sapiens
gctaaccaagaacaagatgcttcac

SEQ ID NO: 38767 - DNA, 23 bp, Homo sapiens
acagttgaagcagtgaggtggtg

SEQ ID NO: 38768 - DNA, 25 bp, Homo sapiens
cttctgtcaatcttcgtgagcggca

SEQ ID NO: 38769 - DNA, 24 bp, Homo sapiens
aacgacaccagatttgaaagaagc

SEQ ID NO: 38770 - DNA, 24 bp, Homo sapiens
aaacgacaccagatttgaaagaag

SEQ ID NO: 38771 - DNA, 24 bp, Homo sapiens
caaacgacaccagatttgaaagaa

SEQ ID NO: 38772 - DNA, 23 bp, Homo sapiens
gagcccgagccgcagccgccgcc

SEQ ID NO: 38773 - DNA, 23 bp, Homo sapiens
tcgaggacaccggagaggggcgc

SEQ ID NO: 38774 - DNA, 23 bp, Homo sapiens
cggctcggcccgacccggctccg

SEQ ID NO: 38775 - DNA, 25 bp, Homo sapiens
gccgcagatttgaaagaagccaaca

SEQ ID NO: 38776 - DNA, 23 bp, Homo sapiens
gagcccgagcccgagccgcagcc

SEQ ID NO: 38777 - DNA, 23 bp, Homo sapiens
cacaaatatacaacaaggccatt

SEQ ID NO: 38778 - DNA, 24 bp, Homo sapiens
tttgataagaaagtaccagatgat

SEQ ID NO: 38779 - DNA, 24 bp, Homo sapiens
ttttgataagaaagtaccagatga

SEQ ID NO: 38780 - DNA, 24 bp, Homo sapiens
tttttgataagaaagtaccagatg

SEQ ID NO: 38781 - DNA, 24 bp, Homo sapiens
ggatacaacgtgtgcatcttcgcc

SEQ ID NO: 38782 - DNA, 24 bp, Homo sapiens
atgggcaagcaggagaaggaccag

SEQ ID NO: 38783 - DNA, 24 bp, Homo sapiens
gcgtcgcagaagcaggtgtaccgg

SEQ ID NO: 38784 - DNA, 24 bp, Homo sapiens
gctgatgtctgagtgcctgctcta

SEQ ID NO: 38785 - DNA, 24 bp, Homo sapiens
gcgagaggcggcaggacattgttc

SEQ ID NO: 38786 - DNA, 24 bp, Homo sapiens
ggcacttcatcaaggaggagcact

SEQ ID NO: 38787 - DNA, 24 bp, Homo sapiens
ctctgagaaagccgccctggatgg

SEQ ID NO: 38788 - DNA, 24 bp, Homo sapiens
caccttccgtgtgacagtcctgca

SEQ ID NO: 38789 - DNA, 24 bp, Homo sapiens
ggatgctgccctggaccacctccg

SEQ ID NO: 38790 - DNA, 24 bp, Homo sapiens
tttctccataggtaaggttgataa

SEQ ID NO: 38791 - DNA, 24 bp, Homo sapiens
ttttctccataggtaaggttgata

SEQ ID NO: 38792 - DNA, 24 bp, Homo sapiens
attttctccataggtaaggttgat

SEQ ID NO: 38793 - DNA, 24 bp, Homo sapiens
attcctcttatgtttgcagtatct

SEQ ID NO: 38794 - DNA, 24 bp, Homo sapiens
tattcctcttatgtttgcagtatc

SEQ ID NO: 38795 - DNA, 24 bp, Homo sapiens
ttattcctcttatgtttgcagtat

SEQ ID NO: 38796 - DNA, 24 bp, Homo sapiens
tccaaaattgggtccagtggttta

SEQ ID NO: 38797 - DNA, 24 bp, Homo sapiens
ttccaaaattgggtccagtggttt

SEQ ID NO: 38798 - DNA, 24 bp, Homo sapiens
tttccaaaattgggtccagtggtt

SEQ ID NO: 38799 - DNA, 25 bp, Homo sapiens
ccttgatcggactcagcattcagat

SEQ ID NO: 38800 - DNA, 24 bp, Homo sapiens
taggaaactggtcaaagaactcat

SEQ ID NO: 38801 - DNA, 23 bp, Homo sapiens
ccttccgccgcctccagcttatg

SEQ ID NO: 38802 - DNA, 23 bp, Homo sapiens
ggacgagtttatgctgccgaccc

SEQ ID NO: 38803 - DNA, 23 bp, Homo sapiens
cctgccactgccgctgcctacag

SEQ ID NO: 38804 - DNA, 23 bp, Homo sapiens
gttatgctgcataccgctacgcc

SEQ ID NO: 38805 - DNA, 25 bp, Homo sapiens
gctacgatgaggagtgtgagaaggc

SEQ ID NO: 38806 - DNA, 24 bp, Homo sapiens
cctcaatatctcgccgtccctcca

SEQ ID NO: 38807 - DNA, 23 bp, Homo sapiens
cctggctggtggtgtacctgtgc

SEQ ID NO: 38808 - DNA, 24 bp, Homo sapiens
tgtggtggcaggactggactctga

SEQ ID NO: 38809 - DNA, 24 bp, Homo sapiens
ttgtggtggcaggactggactctg

SEQ ID NO: 38810 - DNA, 24 bp, Homo sapiens
cttgtggtggcaggactggactct

SEQ ID NO: 38811 - DNA, 24 bp, Homo sapiens
tgtggtggcaggtgcgttgcttca

SEQ ID NO: 38812 - DNA, 24 bp, Homo sapiens
ttgtggtggcaggtgcgttgcttc

SEQ ID NO: 38813 - DNA, 24 bp, Homo sapiens
cttgtggtggcaggtgcgttgctt

SEQ ID NO: 38814 - DNA, 23 bp, Homo sapiens
cctgacgcagacagcctcttcat

SEQ ID NO: 38815 - DNA, 23 bp, Homo sapiens
ttgtggtggcaggactggactct

SEQ ID NO: 38816 - DNA, 25 bp, Homo sapiens
cgaggataacggcatctaccagtgt

SEQ ID NO: 38817 - DNA, 23 bp, Homo sapiens
atgaagacacccgaggctggctt

SEQ ID NO: 38818 - DNA, 23 bp, Homo sapiens
cggaggaagtgaggcaggcagtt

SEQ ID NO: 38819 - DNA, 25 bp, Homo sapiens
cgtctgtctttatcaccctggcacc

SEQ ID NO: 38820 - DNA, 23 bp, Homo sapiens
atggtggctcacgcttgtaatcc

SEQ ID NO: 38821 - DNA, 23 bp, Homo sapiens
gccttccactcctctaccctctg

SEQ ID NO: 38822 - DNA, 25 bp, Homo sapiens
gcacactttccttctgagcctccat

SEQ ID NO: 38823 - DNA, 24 bp, Homo sapiens
acttccgactctggcagcactaca

SEQ ID NO: 38824 - DNA, 24 bp, Homo sapiens
cggacgactcctgtaaacccaaga

SEQ ID NO: 38825 - DNA, 24 bp, Homo sapiens
ccttcctcttccaccaccaccacc

SEQ ID NO: 38826 - DNA, 24 bp, Homo sapiens
tcagaaatcgcagtggatgaaggg

SEQ ID NO: 38827 - DNA, 24 bp, Homo sapiens
cctgcctcctccagccccgccgag

SEQ ID NO: 38828 - DNA, 23 bp, Homo sapiens
ccagcggctcctcaatgtcatcg

SEQ ID NO: 38829 - DNA, 25 bp, Homo sapiens
cggcaccattatgagatgttcacca

SEQ ID NO: 38830 - DNA, 25 bp, Homo sapiens
tccttattcaccttgacaacgccag

SEQ ID NO: 38831 - DNA, 24 bp, Homo sapiens
acggccaaaaagtaaagtatatat

SEQ ID NO: 38832 - DNA, 24 bp, Homo sapiens
aacggccaaaaagtaaagtatata

SEQ ID NO: 38833 - DNA, 24 bp, Homo sapiens
caacggccaaaaagtaaagtatat

SEQ ID NO: 38834 - DNA, 24 bp, Homo sapiens
tggtctcaagcaatcctccctcct

SEQ ID NO: 38835 - DNA, 24 bp, Homo sapiens
ggtctcactatgttgtccaggttg

SEQ ID NO: 38836 - DNA, 24 bp, Homo sapiens
acggaggagatcgagtggctgaag

SEQ ID NO: 38837 - DNA, 23 bp, Homo sapiens
gaaagtggtgaatctcccaacag

SEQ ID NO: 38838 - DNA, 23 bp, Homo sapiens
atccgtgcagaggagctggccca

SEQ ID NO: 38839 - DNA, 23 bp, Homo sapiens
gcagccacagccaacaccagcag

SEQ ID NO: 38840 - DNA, 23 bp, Homo sapiens
tgccaagacaggaccaccaccag

SEQ ID NO: 38841 - DNA, 25 bp, Homo sapiens
cctcttgaatgagatgcctccgacc

SEQ ID NO: 38842 - DNA, 23 bp, Homo sapiens
aagaagggcaggaagggcagcat

SEQ ID NO: 38843 - DNA, 25 bp, Homo sapiens
aatgctaactcctgtctccatcacc

SEQ ID NO: 38844 - DNA, 23 bp, Homo sapiens
cgggacatctgggaagcaagcac

SEQ ID NO: 38845 - DNA, 24 bp, Homo sapiens
taaggacaaaggtgtctggggaaa

SEQ ID NO: 38846 - DNA, 24 bp, Homo sapiens
ttaaggacaaaggtgtctggggaa

SEQ ID NO: 38847 - DNA, 24 bp, Homo sapiens
tttaaggacaaaggtgtctgggga

SEQ ID NO: 38848 - DNA, 25 bp, Homo sapiens
tcaagaagaagacctgcacgacgtt

SEQ ID NO: 38849 - DNA, 23 bp, Homo sapiens
cggagaaggagcagagctggatc

SEQ ID NO: 38850 - DNA, 23 bp, Homo sapiens
ctgggctgcaggaggttgcggcg

SEQ ID NO: 38851 - DNA, 23 bp, Homo sapiens
ggcatgttggtgtggctgtacgg

SEQ ID NO: 38852 - DNA, 25 bp, Homo sapiens
cggaatagagacaccctcatcaacc

SEQ ID NO: 38853 - DNA, 23 bp, Homo sapiens
cttcttcctggtggacgacggca

SEQ ID NO: 38854 - DNA, 25 bp, Homo sapiens
aggctcaggatgtcacggagaatct

SEQ ID NO: 38855 - DNA, 24 bp, Homo sapiens
cgcagtggctcacacctctaatcc

SEQ ID NO: 38856 - DNA, 24 bp, Homo sapiens
ccaggcaggcattcttccttcagg

SEQ ID NO: 38857 - DNA, 24 bp, Homo sapiens
gctttctgcaggtgagtgcatcag

SEQ ID NO: 38858 - DNA, 24 bp, Homo sapiens
tgctttctgcaggtgagtgcatca

SEQ ID NO: 38859 - DNA, 24 bp, Homo sapiens
ctgctttctgcaggtgagtgcatc

SEQ ID NO: 38860 - DNA, 24 bp, Homo sapiens
caacaggagaggtatgtctcaatt

SEQ ID NO: 38861 - DNA, 24 bp, Homo sapiens
gcaacaggagaggtatgtctcaat

SEQ ID NO: 38862 - DNA, 24 bp, Homo sapiens
agcaacaggagaggtatgtctcaa

SEQ ID NO: 38863 - DNA, 23 bp, Homo sapiens
agagactggtggctggaggagac

SEQ ID NO: 38864 - DNA, 23 bp, Homo sapiens
gctggagagtgcgctgcgccgcc

SEQ ID NO: 38865 - DNA, 23 bp, Homo sapiens
ggggttagccactgctggctgct

SEQ ID NO: 38866 - DNA, 24 bp, Homo sapiens
gaaaatgcacaattatcagttaag

SEQ ID NO: 38867 - DNA, 24 bp, Homo sapiens
ggaaaatgcacaattatcagttaa

SEQ ID NO: 38868 - DNA, 24 bp, Homo sapiens
aggaaaatgcacaattatcagtta

SEQ ID NO: 38869 - DNA, 24 bp, Homo sapiens
gtttcatccaggtaattatgaatc

SEQ ID NO: 38870 - DNA, 24 bp, Homo sapiens
agtttcatccaggtaattatgaat

SEQ ID NO: 38871 - DNA, 24 bp, Homo sapiens
aagtttcatccaggtaattatgaa

SEQ ID NO: 38872 - DNA, 24 bp, Homo sapiens
actccatgcaggacctggtcccat

SEQ ID NO: 38873 - DNA, 24 bp, Homo sapiens
gactccatgcaggacctggtccca

SEQ ID NO: 38874 - DNA, 24 bp, Homo sapiens
tgactccatgcaggacctggtccc

SEQ ID NO: 38875 - DNA, 24 bp, Homo sapiens
tccaattatttgatatggaaaaat

SEQ ID NO: 38876 - DNA, 24 bp, Homo sapiens
atccaattatttgatatggaaaaa

SEQ ID NO: 38877 - DNA, 24 bp, Homo sapiens
tatccaattatttgatatggaaaa

SEQ ID NO: 38878 - DNA, 25 bp, Homo sapiens
atcagaggaatcttgagtgccatca

SEQ ID NO: 38879 - DNA, 24 bp, Homo sapiens
gccatctcagctcaccgcaatctc

SEQ ID NO: 38880 - DNA, 25 bp, Homo sapiens
tctttgagagtagaaccaccagatt

SEQ ID NO: 38881 - DNA, 24 bp, Homo sapiens
tgattttcaggatcttatattgca

SEQ ID NO: 38882 - DNA, 24 bp, Homo sapiens
atgattttcaggatcttatattgc

SEQ ID NO: 38883 - DNA, 24 bp, Homo sapiens
catgattttcaggatcttatattg

SEQ ID NO: 38884 - DNA, 24 bp, Homo sapiens
tcattcttcgaaaacatatggttg

SEQ ID NO: 38885 - DNA, 24 bp, Homo sapiens
atcattcttcgaaaacatatggtt

SEQ ID NO: 38886 - DNA, 24 bp, Homo sapiens
catcattcttcgaaaacatatggt

SEQ ID NO: 38887 - DNA, 24 bp, Homo sapiens
ttgttttcaagattaaaaaaagaa

SEQ ID NO: 38888 - DNA, 24 bp, Homo sapiens
cttgttttcaagattaaaaaaaga

SEQ ID NO: 38889 - DNA, 24 bp, Homo sapiens
tcttgttttcaagattaaaaaaag

SEQ ID NO: 38890 - DNA, 23 bp, Homo sapiens
cctcctcagggctccagtcaggc

SEQ ID NO: 38891 - DNA, 23 bp, Homo sapiens
gccgccgtcgccgcagtgtagtt

SEQ ID NO: 38892 - DNA, 24 bp, Homo sapiens
gctcctccttttcctcctcctctt

SEQ ID NO: 38893 - DNA, 24 bp, Homo sapiens
aataacattagctatttgtaaaat

SEQ ID NO: 38894 - DNA, 24 bp, Homo sapiens
aaataacattagctatttgtaaaa

SEQ ID NO: 38895 - DNA, 24 bp, Homo sapiens
aaaataacattagctatttgtaaa

SEQ ID NO: 38896 - DNA, 24 bp, Homo sapiens
tttttcattagttggcatatttag

SEQ ID NO: 38897 - DNA, 24 bp, Homo sapiens
ctttttcattagttggcatattta

SEQ ID NO: 38898 - DNA, 24 bp, Homo sapiens
actttttcattagttggcatattt

SEQ ID NO: 38899 - DNA, 24 bp, Homo sapiens
tcactgtggaggacatcaatgata

SEQ ID NO: 38900 - DNA, 24 bp, Homo sapiens
atcactgtggaggacatcaatgat

SEQ ID NO: 38901 - DNA, 24 bp, Homo sapiens
catcactgtggaggacatcaatga

SEQ ID NO: 38902 - DNA, 24 bp, Homo sapiens
atttattccagaaaaaaagctgtt

SEQ ID NO: 38903 - DNA, 24 bp, Homo sapiens
catttattccagaaaaaaagctgt

SEQ ID NO: 38904 - DNA, 24 bp, Homo sapiens
tcatttattccagaaaaaaagctg

SEQ ID NO: 38905 - DNA, 24 bp, Homo sapiens
ttctcttatagcttatacgacttg

SEQ ID NO: 38906 - DNA, 24 bp, Homo sapiens
tttctcttatagcttatacgactt

SEQ ID NO: 38907 - DNA, 24 bp, Homo sapiens
ttttctcttatagcttatacgact

SEQ ID NO: 38908 - DNA, 24 bp, Homo sapiens
tacctaagcaggtaattatttaag

SEQ ID NO: 38909 - DNA, 24 bp, Homo sapiens
ttacctaagcaggtaattatttaa

SEQ ID NO: 38910 - DNA, 24 bp, Homo sapiens
tttacctaagcaggtaattattta

SEQ ID NO: 38911 - DNA, 24 bp, Homo sapiens
aaattaaagaggttgtggttactt

SEQ ID NO: 38912 - DNA, 24 bp, Homo sapiens
gaaattaaagaggttgtggttact

SEQ ID NO: 38913 - DNA, 24 bp, Homo sapiens
tgaaattaaagaggttgtggttac

SEQ ID NO: 38914 - DNA, 24 bp, Homo sapiens
tatatttttagtgccttccatttt

SEQ ID NO: 38915 - DNA, 24 bp, Homo sapiens
ctatatttttagtgccttccattt

SEQ ID NO: 38916 - DNA, 24 bp, Homo sapiens
tctatatttttagtgccttccatt

SEQ ID NO: 38917 - DNA, 25 bp, Homo sapiens
tatgaagatgatgtcactgatccaa

SEQ ID NO: 38918 - DNA, 24 bp, Homo sapiens
ttacaaggacatcaagcctggacg

SEQ ID NO: 38919 - DNA, 24 bp, Homo sapiens
ctatcccgaattgaagaagccctt

SEQ ID NO: 38920 - DNA, 23 bp, Homo sapiens
aacttgacaccatccgcactggc

SEQ ID NO: 38921 - DNA, 23 bp, Homo sapiens
caccagagcatcctgacacagcg

SEQ ID NO: 38922 - DNA, 24 bp, Homo sapiens
gagcagcggttactggaacaggtg

SEQ ID NO: 38923 - DNA, 24 bp, Homo sapiens
tgacttctcaggttctcggggtgg

SEQ ID NO: 38924 - DNA, 24 bp, Homo sapiens
gtgacttctcaggttctcggggtg

SEQ ID NO: 38925 - DNA, 24 bp, Homo sapiens
cgtgacttctcaggttctcggggt

SEQ ID NO: 38926 - DNA, 23 bp, Homo sapiens
tcaagtgatccacccacctcggc

SEQ ID NO: 38927 - DNA, 25 bp, Homo sapiens
ctagcattataggtgtgacccactg

SEQ ID NO: 38928 - DNA, 25 bp, Homo sapiens
aacattttgagcacttcctttgggc

SEQ ID NO: 38929 - DNA, 25 bp, Homo sapiens
gacttggagcaccgatgacttcttc

SEQ ID NO: 38930 - DNA, 23 bp, Homo sapiens
gctgtggtggtggatgactaccg

SEQ ID NO: 38931 - DNA, 25 bp, Homo sapiens
gtgaacatcctaccgaaccgagtgg

SEQ ID NO: 38932 - DNA, 23 bp, Homo sapiens
tccagtccttcagccactacagt

SEQ ID NO: 38933 - DNA, 25 bp, Homo sapiens
tgtgatgccaagacagatgggagtt

SEQ ID NO: 38934 - DNA, 25 bp, Homo sapiens
gctaattgtaaagtctgctttgtgg

SEQ ID NO: 38935 - DNA, 24 bp, Homo sapiens
cagtggagatgcggaggatgagga

SEQ ID NO: 38936 - DNA, 23 bp, Homo sapiens
atctgatactgcgggctgagggc

SEQ ID NO: 38937 - DNA, 25 bp, Homo sapiens
catcctgctgaatggcctcagtcat

SEQ ID NO: 38938 - DNA, 23 bp, Homo sapiens
caccaagcccacccagcagagtc

SEQ ID NO: 38939 - DNA, 23 bp, Homo sapiens
gccgtggatgtcgctgaattgcc

SEQ ID NO: 38940 - DNA, 24 bp, Homo sapiens
cgcatcgtcaagcaataccaagat

SEQ ID NO: 38941 - DNA, 25 bp, Homo sapiens
ggtgctcagtgttcacgctatatcc

SEQ ID NO: 38942 - DNA, 23 bp, Homo sapiens
ccagccacctcccactcagccat

SEQ ID NO: 38943 - DNA, 25 bp, Homo sapiens
cacaggtgactcgaatgaactctgc

SEQ ID NO: 38944 - DNA, 23 bp, Homo sapiens
gacctcgccatctatgctgctgc

SEQ ID NO: 38945 - DNA, 23 bp, Homo sapiens
aatgactcctgcggtgtggaagc

SEQ ID NO: 38946 - DNA, 24 bp, Homo sapiens
gtggacgcctaccgcatctacttg

SEQ ID NO: 38947 - DNA, 23 bp, Homo sapiens
atggcgtgcataccgtggaggat

SEQ ID NO: 38948 - DNA, 23 bp, Homo sapiens
aggagatgctgctgcgagtgtct

SEQ ID NO: 38949 - DNA, 23 bp, Homo sapiens
caaggaggagctggagtcgtacc

SEQ ID NO: 38950 - DNA, 24 bp, Homo sapiens
ataagaatgaggtagatttgttat

SEQ ID NO: 38951 - DNA, 24 bp, Homo sapiens
cataagaatgaggtagatttgtta

SEQ ID NO: 38952 - DNA, 24 bp, Homo sapiens
ccataagaatgaggtagatttgtt

SEQ ID NO: 38953 - DNA, 24 bp, Homo sapiens
aaagaaaaatggtaattcttacaa

SEQ ID NO: 38954 - DNA, 24 bp, Homo sapiens
gaaagaaaaatggtaattcttaca

SEQ ID NO: 38955 - DNA, 24 bp, Homo sapiens
tgaaagaaaaatggtaattcttac

SEQ ID NO: 38956 - DNA, 24 bp, Homo sapiens
ttttttaacagagtaaaaagaagt

SEQ ID NO: 38957 - DNA, 24 bp, Homo sapiens
tttttttaacagagtaaaaagaag

SEQ ID NO: 38958 - DNA, 24 bp, Homo sapiens
atttttttaacagagtaaaaagaa

SEQ ID NO: 38959 - DNA, 24 bp, Homo sapiens
gcaggacagcgagaagttgtagca

SEQ ID NO: 38960 - DNA, 25 bp, Homo sapiens
atccaaagatgaagagccacggttt

SEQ ID NO: 38961 - DNA, 25 bp, Homo sapiens
ggatcagttcgacagcttagacaag

SEQ ID NO: 38962 - DNA, 24 bp, Homo sapiens
agatttacaaggactctcaaatgg

SEQ ID NO: 38963 - DNA, 24 bp, Homo sapiens
cagatttacaaggactctcaaatg

SEQ ID NO: 38964 - DNA, 24 bp, Homo sapiens
tcagatttacaaggactctcaaat

SEQ ID NO: 38965 - DNA, 24 bp, Homo sapiens
tagaaaaaaaggtatgcttttaaa

SEQ ID NO: 38966 - DNA, 24 bp, Homo sapiens
ttagaaaaaaaggtatgcttttaa

SEQ ID NO: 38967 - DNA, 24 bp, Homo sapiens
gttagaaaaaaaggtatgctttta

SEQ ID NO: 38968 - DNA, 24 bp, Homo sapiens
tacaactaaagagccaagaaaatg

SEQ ID NO: 38969 - DNA, 24 bp, Homo sapiens
ctacaactaaagagccaagaaaat

SEQ ID NO: 38970 - DNA, 24 bp, Homo sapiens
actacaactaaagagccaagaaaa

SEQ ID NO: 38971 - DNA, 25 bp, Homo sapiens
tactctgtctcccaggctgaagtgc

SEQ ID NO: 38972 - DNA, 23 bp, Homo sapiens
aaacctccgcctgccagactcga

SEQ ID NO: 38973 - DNA, 25 bp, Homo sapiens
tcctgacacggtatctgctccaact

SEQ ID NO: 38974 - DNA, 24 bp, Homo sapiens
aactgcggactgtgaggagaatat

SEQ ID NO: 38975 - DNA, 25 bp, Homo sapiens
atgttgagcggtattcctggagtca

SEQ ID NO: 38976 - DNA, 24 bp, Homo sapiens
tggctacatgatggctaaggcacc

SEQ ID NO: 38977 - DNA, 24 bp, Homo sapiens
agctcaactgagtaagcaagtttg

SEQ ID NO: 38978 - DNA, 24 bp, Homo sapiens
aagctcaactgagtaagcaagttt

SEQ ID NO: 38979 - DNA, 24 bp, Homo sapiens
gaagctcaactgagtaagcaagtt

SEQ ID NO: 38980 - DNA, 23 bp, Homo sapiens
tgcctataatcccagcagtttgg

SEQ ID NO: 38981 - DNA, 23 bp, Homo sapiens
aaaatatctgccaggggccgggc

SEQ ID NO: 38982 - DNA, 24 bp, Homo sapiens
gttgtacgaaggggtggcacagaa

SEQ ID NO: 38983 - DNA, 24 bp, Homo sapiens
agttgtacgaaggggtggcacaga

SEQ ID NO: 38984 - DNA, 24 bp, Homo sapiens
aagttgtacgaaggggtggcacag

SEQ ID NO: 38985 - DNA, 24 bp, Homo sapiens
gtgaaccgtgacgagtacctgctg

SEQ ID NO: 38986 - DNA, 23 bp, Homo sapiens
gatggaggagaaggaggcaggct

SEQ ID NO: 38987 - DNA, 25 bp, Homo sapiens
gacttctcccaggctctatctttgc

SEQ ID NO: 38988 - DNA, 23 bp, Homo sapiens
ggcaacagcaacagcagcagcag

SEQ ID NO: 38989 - DNA, 25 bp, Homo sapiens
gtcctcctaccatctgctcatctcc

SEQ ID NO: 38990 - DNA, 23 bp, Homo sapiens
gagccaggtgtctctgccaacag

SEQ ID NO: 38991 - DNA, 24 bp, Homo sapiens
ccaaaaaaatggtaagttctgcaa

SEQ ID NO: 38992 - DNA, 24 bp, Homo sapiens
gccaaaaaaatggtaagttctgca

SEQ ID NO: 38993 - DNA, 24 bp, Homo sapiens
tgccaaaaaaatggtaagttctgc

SEQ ID NO: 38994 - DNA, 24 bp, Homo sapiens
ctgtctttaaggtaagatttttta

SEQ ID NO: 38995 - DNA, 24 bp, Homo sapiens
tctgtctttaaggtaagatttttt

SEQ ID NO: 38996 - DNA, 24 bp, Homo sapiens
ttctgtctttaaggtaagattttt

SEQ ID NO: 38997 - DNA, 24 bp, Homo sapiens
tatattaaatggtgagttgatttt

SEQ ID NO: 38998 - DNA, 24 bp, Homo sapiens
ttatattaaatggtgagttgattt

SEQ ID NO: 38999 - DNA, 24 bp, Homo sapiens
attatattaaatggtgagttgatt

SEQ ID NO: 39000 - DNA, 23 bp, Homo sapiens
gctgaagtgatcctcctgcctca

SEQ ID NO: 39001 - DNA, 23 bp, Homo sapiens
aggatgtcgctctgtcacccagg

SEQ ID NO: 39002 - DNA, 25 bp, Homo sapiens
tgtctcactgaataaacactttcgt

SEQ ID NO: 39003 - DNA, 25 bp, Homo sapiens
tggagcacattctggttcgtctgga

SEQ ID NO: 39004 - DNA, 25 bp, Homo sapiens
ttctttcctgcctgtgaatcagccg

SEQ ID NO: 39005 - DNA, 23 bp, Homo sapiens
gccgctgccaggaggttctatca

SEQ ID NO: 39006 - DNA, 23 bp, Homo sapiens
gtggatgggtggcaggtagtgga

SEQ ID NO: 39007 - DNA, 25 bp, Homo sapiens
ctgtgattcttgcttctgtgtctgt

SEQ ID NO: 39008 - DNA, 25 bp, Homo sapiens
gtgagaactacgaagccctactgga

SEQ ID NO: 39009 - DNA, 24 bp, Homo sapiens
tgtcttggcagacctggtgatgct

SEQ ID NO: 39010 - DNA, 24 bp, Homo sapiens
atgtcttggcagacctggtgatgc

SEQ ID NO: 39011 - DNA, 24 bp, Homo sapiens
tatgtcttggcagacctggtgatg

SEQ ID NO: 39012 - DNA, 24 bp, Homo sapiens
aggaggaggtgtggacagtgatgg

SEQ ID NO: 39013 - DNA, 23 bp, Homo sapiens
gatcctccgtggaccgaaccgtc

SEQ ID NO: 39014 - DNA, 25 bp, Homo sapiens
tcctaccacctacctcattctgcct

SEQ ID NO: 39015 - DNA, 24 bp, Homo sapiens
catggctgtggtggccgtgttgga

SEQ ID NO: 39016 - DNA, 24 bp, Homo sapiens
ccatggctgtggtggccgtgttgg

SEQ ID NO: 39017 - DNA, 24 bp, Homo sapiens
tccatggctgtggtggccgtgttg

SEQ ID NO: 39018 - DNA, 24 bp, Homo sapiens
gtttgacaaaggtaagtaaaagat

SEQ ID NO: 39019 - DNA, 24 bp, Homo sapiens
ggtttgacaaaggtaagtaaaaga

SEQ ID NO: 39020 - DNA, 24 bp, Homo sapiens
aggtttgacaaaggtaagtaaaag

SEQ ID NO: 39021 - DNA, 24 bp, Homo sapiens
gacaattaaaggtaatcgttgaaa

SEQ ID NO: 39022 - DNA, 24 bp, Homo sapiens
agacaattaaaggtaatcgttgaa

SEQ ID NO: 39023 - DNA, 24 bp, Homo sapiens
gagacaattaaaggtaatcgttga

SEQ ID NO: 39024 - DNA, 25 bp, Homo sapiens
tgcctgatgatctgtcactgtctcc

SEQ ID NO: 39025 - DNA, 23 bp, Homo sapiens
ccagatgggaccttgtagttgca

SEQ ID NO: 39026 - DNA, 24 bp, Homo sapiens
cattatgtcagtggaagagaaagc

SEQ ID NO: 39027 - DNA, 24 bp, Homo sapiens
acattatgtcagtggaagagaaag

SEQ ID NO: 39028 - DNA, 24 bp, Homo sapiens
gacattatgtcagtggaagagaaa

SEQ ID NO: 39029 - DNA, 25 bp, Homo sapiens
accgacgaatctttacctacactga

SEQ ID NO: 39030 - DNA, 24 bp, Homo sapiens
cagcctgtcagagtcctttggatt

SEQ ID NO: 39031 - DNA, 24 bp, Homo sapiens
aggagatcctgaagctggagaatt

SEQ ID NO: 39032 - DNA, 24 bp, Homo sapiens
atgtaaaactggtaagatgactta

SEQ ID NO: 39033 - DNA, 24 bp, Homo sapiens
aatgtaaaactggtaagatgactt

SEQ ID NO: 39034 - DNA, 24 bp, Homo sapiens
gaatgtaaaactggtaagatgact

SEQ ID NO: 39035 - DNA, 24 bp, Homo sapiens
cttttttaaagattcggaaacccc

SEQ ID NO: 39036 - DNA, 24 bp, Homo sapiens
tcttttttaaagattcggaaaccc

SEQ ID NO: 39037 - DNA, 24 bp, Homo sapiens
atcttttttaaagattcggaaacc

SEQ ID NO: 39038 - DNA, 24 bp, Homo sapiens
agagaatgaagttacaaattgcca

SEQ ID NO: 39039 - DNA, 24 bp, Homo sapiens
cagagaatgaagttacaaattgcc

SEQ ID NO: 39040 - DNA, 24 bp, Homo sapiens
gcagagaatgaagttacaaattgc

SEQ ID NO: 39041 - DNA, 24 bp, Homo sapiens
acgccagccactgcccgactccaa

SEQ ID NO: 39042 - DNA, 24 bp, Homo sapiens
aacgccagccactgcccgactcca

SEQ ID NO: 39043 - DNA, 24 bp, Homo sapiens
caacgccagccactgcccgactcc

SEQ ID NO: 39044 - DNA, 24 bp, Homo sapiens
tattcttttaggattttcctgttg

SEQ ID NO: 39045 - DNA, 24 bp, Homo sapiens
ctattcttttaggattttcctgtt

SEQ ID NO: 39046 - DNA, 24 bp, Homo sapiens
tctattcttttaggattttcctgt

SEQ ID NO: 39047 - DNA, 24 bp, Homo sapiens
catgtttgcaggtaaaagatttga

SEQ ID NO: 39048 - DNA, 24 bp, Homo sapiens
ccatgtttgcaggtaaaagatttg

SEQ ID NO: 39049 - DNA, 24 bp, Homo sapiens
tccatgtttgcaggtaaaagattt

SEQ ID NO: 39050 - DNA, 23 bp, Homo sapiens
cgagctagggtgacaggcccggc

SEQ ID NO: 39051 - DNA, 23 bp, Homo sapiens
caccgccgctgccgcctcgccag

SEQ ID NO: 39052 - DNA, 23 bp, Homo sapiens
gcctcctcagtgcgtccgcgtcc

SEQ ID NO: 39053 - DNA, 23 bp, Homo sapiens
gcctcctcagtgcgtccgcgtcc

SEQ ID NO: 39054 - DNA, 23 bp, Homo sapiens
gcgagctagggtgacaggcccgg

SEQ ID NO: 39055 - DNA, 23 bp, Homo sapiens
caccgccgctgccgcctcgccag

SEQ ID NO: 39056 - DNA, 24 bp, Homo sapiens
taaaatcatcggatttttatatta

SEQ ID NO: 39057 - DNA, 24 bp, Homo sapiens
gtaaaatcatcggatttttatatt

SEQ ID NO: 39058 - DNA, 24 bp, Homo sapiens
agtaaaatcatcggatttttatat

SEQ ID NO: 39059 - DNA, 25 bp, Homo sapiens
gaccgttactccttcttccacaagc

SEQ ID NO: 39060 - DNA, 24 bp, Homo sapiens
tctgctgctcagtagcctcaacga

SEQ ID NO: 39061 - DNA, 23 bp, Homo sapiens
gtggtgggcggctggctgctgtg

SEQ ID NO: 39062 - DNA, 24 bp, Homo sapiens
caaaataataggctgtaacagagg

SEQ ID NO: 39063 - DNA, 24 bp, Homo sapiens
acaaaataataggctgtaacagag

SEQ ID NO: 39064 - DNA, 24 bp, Homo sapiens
aacaaaataataggctgtaacaga

SEQ ID NO: 39065 - DNA, 25 bp, Homo sapiens
agatgagtctcgctctgtcaccagg

SEQ ID NO: 39066 - DNA, 25 bp, Homo sapiens
agtgaactgaagacaactctggctt

SEQ ID NO: 39067 - DNA, 24 bp, Homo sapiens
gccttgagtgatcctcctgccttg

SEQ ID NO: 39068 - DNA, 23 bp, Homo sapiens
gttgctggtggtggcttggagtg

SEQ ID NO: 39069 - DNA, 23 bp, Homo sapiens
tcagactgccttggaggaggtgg

SEQ ID NO: 39070 - DNA, 25 bp, Homo sapiens
ggtctgcggagtagtagatcctgag

SEQ ID NO: 39071 - DNA, 24 bp, Homo sapiens
cgtctcgctggcaacaggtgtgcc

SEQ ID NO: 39072 - DNA, 24 bp, Homo sapiens
acgtctcgctggcaacaggtgtgc

SEQ ID NO: 39073 - DNA, 24 bp, Homo sapiens
cacgtctcgctggcaacaggtgtg

SEQ ID NO: 39074 - DNA, 24 bp, Homo sapiens
tccagcagagggtggtccgagtct

SEQ ID NO: 39075 - DNA, 24 bp, Homo sapiens
atccagcagagggtggtccgagtc

SEQ ID NO: 39076 - DNA, 24 bp, Homo sapiens
aatccagcagagggtggtccgagt

SEQ ID NO: 39077 - DNA, 23 bp, Homo sapiens
ctctggttgctggtggtgctgtg

SEQ ID NO: 39078 - DNA, 24 bp, Homo sapiens
cctgttcatcctgtggctctggac

SEQ ID NO: 39079 - DNA, 23 bp, Homo sapiens
ccctgctgtccgattctgccttc

SEQ ID NO: 39080 - DNA, 24 bp, Homo sapiens
ctgctggctggcttggacaaggtg

SEQ ID NO: 39081 - DNA, 24 bp, Homo sapiens
gccaaggacctcaagaacatcacc

SEQ ID NO: 39082 - DNA, 24 bp, Homo sapiens
ctgcggattgaacctgagaagacg

SEQ ID NO: 39083 - DNA, 24 bp, Homo sapiens
gcaggagccaggcccagccccaga

SEQ ID NO: 39084 - DNA, 24 bp, Homo sapiens
tgcaggagccaggcccagccccag

SEQ ID NO: 39085 - DNA, 24 bp, Homo sapiens
gtgcaggagccaggcccagcccca

SEQ ID NO: 39086 - DNA, 24 bp, Homo sapiens
agttcagtgatgacttggatgttg

SEQ ID NO: 39087 - DNA, 24 bp, Homo sapiens
gagttcagtgatgacttggatgtt

SEQ ID NO: 39088 - DNA, 24 bp, Homo sapiens
ggagttcagtgatgacttggatgt

SEQ ID NO: 39089 - DNA, 23 bp, Homo sapiens
tgcccaaccagacccacccagac

SEQ ID NO: 39090 - DNA, 23 bp, Homo sapiens
tccacatggtcggagacaagcca

SEQ ID NO: 39091 - DNA, 25 bp, Homo sapiens
gcctggtcaacttcacattcaacaa

SEQ ID NO: 39092 - DNA, 24 bp, Homo sapiens
tttatgactagacctagaggatca

SEQ ID NO: 39093 - DNA, 24 bp, Homo sapiens
atttatgactagacctagaggatc

SEQ ID NO: 39094 - DNA, 24 bp, Homo sapiens
gatttatgactagacctagaggat

SEQ ID NO: 39095 - DNA, 24 bp, Homo sapiens
tattgtccaaggtagaaacttctc

SEQ ID NO: 39096 - DNA, 24 bp, Homo sapiens
atattgtccaaggtagaaacttct

SEQ ID NO: 39097 - DNA, 24 bp, Homo sapiens
catattgtccaaggtagaaacttc

SEQ ID NO: 39098 - DNA, 23 bp, Homo sapiens
ggctcttggctgctgtggctgcg

SEQ ID NO: 39099 - DNA, 23 bp, Homo sapiens
ggaagtggatgtcgccaaggtgg

SEQ ID NO: 39100 - DNA, 24 bp, Homo sapiens
aaatatttgaaaatgaagtcatgg

SEQ ID NO: 39101 - DNA, 24 bp, Homo sapiens
gaaatatttgaaaatgaagtcatg

SEQ ID NO: 39102 - DNA, 24 bp, Homo sapiens
agaaatatttgaaaatgaagtcat

SEQ ID NO: 39103 - DNA, 24 bp, Homo sapiens
gtttacacaagagattatggagaa

SEQ ID NO: 39104 - DNA, 24 bp, Homo sapiens
tgtttacacaagagattatggaga

SEQ ID NO: 39105 - DNA, 24 bp, Homo sapiens
ttgtttacacaagagattatggag

SEQ ID NO: 39106 - DNA, 24 bp, Homo sapiens
atccctaaagcacatatgaagaag

SEQ ID NO: 39107 - DNA, 24 bp, Homo sapiens
aatccctaaagcacatatgaagaa

SEQ ID NO: 39108 - DNA, 24 bp, Homo sapiens
caatccctaaagcacatatgaaga

SEQ ID NO: 39109 - DNA, 24 bp, Homo sapiens
tagaaggacagaaaaaatcttcta

SEQ ID NO: 39110 - DNA, 24 bp, Homo sapiens
ttagaaggacagaaaaaatcttct

SEQ ID NO: 39111 - DNA, 24 bp, Homo sapiens
attagaaggacagaaaaaatcttc

SEQ ID NO: 39112 - DNA, 24 bp, Homo sapiens
tcttgtacaagatatcctattgaa

SEQ ID NO: 39113 - DNA, 24 bp, Homo sapiens
atcttgtacaagatatcctattga

SEQ ID NO: 39114 - DNA, 24 bp, Homo sapiens
gatcttgtacaagatatcctattg

SEQ ID NO: 39115 - DNA, 23 bp, Homo sapiens
cctcagcaacctggcggaacagc

SEQ ID NO: 39116 - DNA, 23 bp, Homo sapiens
ctggtggctggtgacatcgtcct

SEQ ID NO: 39117 - DNA, 24 bp, Homo sapiens
tagccatcctcctcaaggtgcgag

SEQ ID NO: 39118 - DNA, 23 bp, Homo sapiens
cctcagcaacctggcggaacagc

SEQ ID NO: 39119 - DNA, 23 bp, Homo sapiens
ccgtggtggaggagcagcagggc

SEQ ID NO: 39120 - DNA, 23 bp, Homo sapiens
agagtgccctgcgggactgccag

SEQ ID NO: 39121 - DNA, 23 bp, Homo sapiens
gaccacgggcaccacagttgaag

SEQ ID NO: 39122 - DNA, 25 bp, Homo sapiens
acatcagtgccttgaaccttaggac

SEQ ID NO: 39123 - DNA, 23 bp, Homo sapiens
gaggctcagggaagtggatggag

SEQ ID NO: 39124 - DNA, 25 bp, Homo sapiens
cggtgtgaggtttagtgtgggagta

SEQ ID NO: 39125 - DNA, 24 bp, Homo sapiens
agaatttcgctcttgttgcccagg

SEQ ID NO: 39126 - DNA, 23 bp, Homo sapiens
caatggcgcgatctcggctcacc

SEQ ID NO: 39127 - DNA, 25 bp, Homo sapiens
ctccagcagtaccgtgacttcatcg

SEQ ID NO: 39128 - DNA, 23 bp, Homo sapiens
agatgctgctgctggtggcacag

SEQ ID NO: 39129 - DNA, 23 bp, Homo sapiens
tcagagtggaacgcagcaaacct

SEQ ID NO: 39130 - DNA, 24 bp, Homo sapiens
ggaggaggtgaggctgcgctggcc

SEQ ID NO: 39131 - DNA, 24 bp, Homo sapiens
tggaggaggtgaggctgcgctggc

SEQ ID NO: 39132 - DNA, 24 bp, Homo sapiens
ctggaggaggtgaggctgcgctgg

SEQ ID NO: 39133 - DNA, 24 bp, Homo sapiens
caagaagacagccaccacgaggac

SEQ ID NO: 39134 - DNA, 25 bp, Homo sapiens
gctaacgctgctggactacctcttc

SEQ ID NO: 39135 - DNA, 23 bp, Homo sapiens
gcaggctgtgtccaacctctcgg

SEQ ID NO: 39136 - DNA, 23 bp, Homo sapiens
cgcaaggagcaggagacggcatt

SEQ ID NO: 39137 - DNA, 23 bp, Homo sapiens
tacagccacctcaagagcgtcct

SEQ ID NO: 39138 - DNA, 23 bp, Homo sapiens
agacggctctgtgactgtggagt

SEQ ID NO: 39139 - DNA, 23 bp, Homo sapiens
ctgcctggattgacaagtgccgc

SEQ ID NO: 39140 - DNA, 23 bp, Homo sapiens
acgaccatccgtgactccaagcg

SEQ ID NO: 39141 - DNA, 23 bp, Homo sapiens
gcatcctcctggagaccttctgg

SEQ ID NO: 39142 - DNA, 24 bp, Homo sapiens
ttaattttcagcttcctaatgaag

SEQ ID NO: 39143 - DNA, 24 bp, Homo sapiens
gttaattttcagcttcctaatgaa

SEQ ID NO: 39144 - DNA, 24 bp, Homo sapiens
tgttaattttcagcttcctaatga

SEQ ID NO: 39145 - DNA, 24 bp, Homo sapiens
ggcaaagggctgatgtcggtagtc

SEQ ID NO: 39146 - DNA, 23 bp, Homo sapiens
atggagaacacggacactgatgt

SEQ ID NO: 39147 - DNA, 23 bp, Homo sapiens
aggtccactgctggtgtcagagg

SEQ ID NO: 39148 - DNA, 24 bp, Homo sapiens
ctgaagatcagttgctatacctgc

SEQ ID NO: 39149 - DNA, 24 bp, Homo sapiens
tctgaagatcagttgctatacctg

SEQ ID NO: 39150 - DNA, 24 bp, Homo sapiens
ttctgaagatcagttgctatacct

SEQ ID NO: 39151 - DNA, 24 bp, Homo sapiens
aacatgaacagttgctatacctgc

SEQ ID NO: 39152 - DNA, 24 bp, Homo sapiens
aaacatgaacagttgctatacctg

SEQ ID NO: 39153 - DNA, 24 bp, Homo sapiens
taaacatgaacagttgctatacct

SEQ ID NO: 39154 - DNA, 23 bp, Homo sapiens
ggtcaccgaggagatcgccacct

SEQ ID NO: 39155 - DNA, 23 bp, Homo sapiens
gctgggctgtttcctggctggag

SEQ ID NO: 39156 - DNA, 23 bp, Homo sapiens
aacccatccgcgacttcctggcc

SEQ ID NO: 39157 - DNA, 24 bp, Homo sapiens
aaagctcacaaaggacaggtgacc

SEQ ID NO: 39158 - DNA, 24 bp, Homo sapiens
taaagctcacaaaggacaggtgac

SEQ ID NO: 39159 - DNA, 24 bp, Homo sapiens
ttaaagctcacaaaggacaggtga

SEQ ID NO: 39160 - DNA, 23 bp, Homo sapiens
gtagcaggacaagccgcagacaa

SEQ ID NO: 39161 - DNA, 25 bp, Homo sapiens
tcacttctccagacatatctcagca

SEQ ID NO: 39162 - DNA, 25 bp, Homo sapiens
aaatgctgctgctttcctctctgtt

SEQ ID NO: 39163 - DNA, 24 bp, Homo sapiens
tcaactgtagcctcaacctcctgg

SEQ ID NO: 39164 - DNA, 23 bp, Homo sapiens
ggactacaggcggcaggcacacg

SEQ ID NO: 39165 - DNA, 23 bp, Homo sapiens
aggctggagtgcagtggcgtgat

SEQ ID NO: 39166 - DNA, 24 bp, Homo sapiens
ttttcaagtagaaagtttttaaaa

SEQ ID NO: 39167 - DNA, 24 bp, Homo sapiens
cttttcaagtagaaagtttttaaa

SEQ ID NO: 39168 - DNA, 24 bp, Homo sapiens
tcttttcaagtagaaagtttttaa

SEQ ID NO: 39169 - DNA, 24 bp, Homo sapiens
tacgcttttctgtgagtactaatg

SEQ ID NO: 39170 - DNA, 24 bp, Homo sapiens
atacgcttttctgtgagtactaat

SEQ ID NO: 39171 - DNA, 24 bp, Homo sapiens
catacgcttttctgtgagtactaa

SEQ ID NO: 39172 - DNA, 23 bp, Homo sapiens
ctctgctgctgctgaccaaccac

SEQ ID NO: 39173 - DNA, 23 bp, Homo sapiens
aagcgggatgtacttctgttggg

SEQ ID NO: 39174 - DNA, 23 bp, Homo sapiens
cagtcaccagcgttcgggagcct

SEQ ID NO: 39175 - DNA, 25 bp, Homo sapiens
cttctacgtgatcctgggcttctgc

SEQ ID NO: 39176 - DNA, 23 bp, Homo sapiens
cgccacacaacagcacgcacacg

SEQ ID NO: 39177 - DNA, 23 bp, Homo sapiens
gccgctgctgctgctcctgctgg

SEQ ID NO: 39178 - DNA, 24 bp, Homo sapiens
caaaatatgtggtaaaagaagata

SEQ ID NO: 39179 - DNA, 24 bp, Homo sapiens
tcaaaatatgtggtaaaagaagat

SEQ ID NO: 39180 - DNA, 24 bp, Homo sapiens
ctcaaaatatgtggtaaaagaaga

SEQ ID NO: 39181 - DNA, 24 bp, Homo sapiens
aaagttactctgcactgtttttga

SEQ ID NO: 39182 - DNA, 24 bp, Homo sapiens
caaagttactctgcactgtttttg

SEQ ID NO: 39183 - DNA, 24 bp, Homo sapiens
tcaaagttactctgcactgttttt

SEQ ID NO: 39184 - DNA, 24 bp, Homo sapiens
gtcctgctcggccaaaatctcatg

SEQ ID NO: 39185 - DNA, 24 bp, Homo sapiens
agtcctgctcggccaaaatctcat

SEQ ID NO: 39186 - DNA, 24 bp, Homo sapiens
cagtcctgctcggccaaaatctca

SEQ ID NO: 39187 - DNA, 23 bp, Homo sapiens
tgcaccaccaccatcagatcctt

SEQ ID NO: 39188 - DNA, 25 bp, Homo sapiens
tgatagaggactaggaagagaagcc

SEQ ID NO: 39189 - DNA, 25 bp, Homo sapiens
tgacctggctgtggcttatattctc

SEQ ID NO: 39190 - DNA, 24 bp, Homo sapiens
tttattatagggtaagtagtgtct

SEQ ID NO: 39191 - DNA, 24 bp, Homo sapiens
ttttattatagggtaagtagtgtc

SEQ ID NO: 39192 - DNA, 24 bp, Homo sapiens
gttttattatagggtaagtagtgt

SEQ ID NO: 39193 - DNA, 24 bp, Homo sapiens
tgttcttaaaggaaagataaaaat

SEQ ID NO: 39194 - DNA, 24 bp, Homo sapiens
atgttcttaaaggaaagataaaaa

SEQ ID NO: 39195 - DNA, 24 bp, Homo sapiens
tatgttcttaaaggaaagataaaa

SEQ ID NO: 39196 - DNA, 24 bp, Homo sapiens
accttgctaaggtatactacaaat

SEQ ID NO: 39197 - DNA, 24 bp, Homo sapiens
gaccttgctaaggtatactacaaa

SEQ ID NO: 39198 - DNA, 24 bp, Homo sapiens
agaccttgctaaggtatactacaa

SEQ ID NO: 39199 - DNA, 25 bp, Homo sapiens
tggaagaagacctaacttggcagca

SEQ ID NO: 39200 - DNA, 23 bp, Homo sapiens
cccgcctcatccaagcattaagc

SEQ ID NO: 39201 - DNA, 23 bp, Homo sapiens
gctcaggagttggagacaagcct

SEQ ID NO: 39202 - DNA, 25 bp, Homo sapiens
tcaagcaatactcagacttcagcct

SEQ ID NO: 39203 - DNA, 24 bp, Homo sapiens
ataggcgtgaaccactgtgactgg

SEQ ID NO: 39204 - DNA, 23 bp, Homo sapiens
ttgcccaggatggtctcaaactc

SEQ ID NO: 39205 - DNA, 24 bp, Homo sapiens
tctttttccaggaaatacaaaaga

SEQ ID NO: 39206 - DNA, 24 bp, Homo sapiens
ttctttttccaggaaatacaaaag

SEQ ID NO: 39207 - DNA, 24 bp, Homo sapiens
tttctttttccaggaaatacaaaa

SEQ ID NO: 39208 - DNA, 25 bp, Homo sapiens
gtgatgacatggtgactaaggatat

SEQ ID NO: 39209 - DNA, 23 bp, Homo sapiens
gaggcggctgcggcggcgaatgg

SEQ ID NO: 39210 - DNA, 23 bp, Homo sapiens
cttcaagcgacctcagttctccc

SEQ ID NO: 39211 - DNA, 24 bp, Homo sapiens
tcataaacaagaaaacaagtatga

SEQ ID NO: 39212 - DNA, 24 bp, Homo sapiens
atcataaacaagaaaacaagtatg

SEQ ID NO: 39213 - DNA, 24 bp, Homo sapiens
catcataaacaagaaaacaagtat

SEQ ID NO: 39214 - DNA, 24 bp, Homo sapiens
ttattttgtaggttaaagcatatt

SEQ ID NO: 39215 - DNA, 24 bp, Homo sapiens
gttattttgtaggttaaagcatat

SEQ ID NO: 39216 - DNA, 24 bp, Homo sapiens
tgttattttgtaggttaaagcata

SEQ ID NO: 39217 - DNA, 25 bp, Homo sapiens
tctggtgaatgaggcacagtatctg

SEQ ID NO: 39218 - DNA, 25 bp, Homo sapiens
cggcaactaaacaccagtgatgaga

SEQ ID NO: 39219 - DNA, 25 bp, Homo sapiens
gccttgtcacagatgccagatgatt

SEQ ID NO: 39220 - DNA, 24 bp, Homo sapiens
cctgaaaaaatccatttttcacgt

SEQ ID NO: 39221 - DNA, 24 bp, Homo sapiens
acctgaaaaaatccatttttcacg

SEQ ID NO: 39222 - DNA, 24 bp, Homo sapiens
gacctgaaaaaatccatttttcac

SEQ ID NO: 39223 - DNA, 24 bp, Homo sapiens
ctaacttgcagcctgggcgacaga

SEQ ID NO: 39224 - DNA, 24 bp, Homo sapiens
gctaacttgcagcctgggcgacag

SEQ ID NO: 39225 - DNA, 24 bp, Homo sapiens
tgctaacttgcagcctgggcgaca

SEQ ID NO: 39226 - DNA, 24 bp, Homo sapiens
ttttacattagggattgaagaagt

SEQ ID NO: 39227 - DNA, 24 bp, Homo sapiens
tttttacattagggattgaagaag

SEQ ID NO: 39228 - DNA, 24 bp, Homo sapiens
ttttttacattagggattgaagaa

SEQ ID NO: 39229 - DNA, 24 bp, Homo sapiens
ctgatatagaggacacaatgtttg

SEQ ID NO: 39230 - DNA, 24 bp, Homo sapiens
actgatatagaggacacaatgttt

SEQ ID NO: 39231 - DNA, 24 bp, Homo sapiens
aactgatatagaggacacaatgtt

SEQ ID NO: 39232 - DNA, 23 bp, Homo sapiens
gtggcggtggctgagcagaggac

SEQ ID NO: 39233 - DNA, 23 bp, Homo sapiens
ccgtcgggcgctccttcctcagc

SEQ ID NO: 39234 - DNA, 23 bp, Homo sapiens
gagagcgcagcgtcgaccctttg

SEQ ID NO: 39235 - DNA, 24 bp, Homo sapiens
cgccagacatcttagccaggaaat

SEQ ID NO: 39236 - DNA, 24 bp, Homo sapiens
tctactccaagtgaccaacagcaa

SEQ ID NO: 39237 - DNA, 24 bp, Homo sapiens
gcagatggagaaagcatgaatacg

SEQ ID NO: 39238 - DNA, 25 bp, Homo sapiens
gcctcctgaagtcctggaattacag

SEQ ID NO: 39239 - DNA, 25 bp, Homo sapiens
gcccatttaatactctgagccccac

SEQ ID NO: 39240 - DNA, 25 bp, Homo sapiens
aactactggcctcaagtgatcctct

SEQ ID NO: 39241 - DNA, 25 bp, Homo sapiens
acgacccgctggaaggaaagagata

SEQ ID NO: 39242 - DNA, 25 bp, Homo sapiens
gcctcctgaagtcctggaattacag

SEQ ID NO: 39243 - DNA, 23 bp, Homo sapiens
ggtctcgctctgttgcccagtgg

SEQ ID NO: 39244 - DNA, 24 bp, Homo sapiens
tttttatacagaaaaatgtgagtt

SEQ ID NO: 39245 - DNA, 24 bp, Homo sapiens
ctttttatacagaaaaatgtgagt

SEQ ID NO: 39246 - DNA, 24 bp, Homo sapiens
tctttttatacagaaaaatgtgag

SEQ ID NO: 39247 - DNA, 25 bp, Homo sapiens
ctacagcctcaccagcgactacaag

SEQ ID NO: 39248 - DNA, 24 bp, Homo sapiens
gaagattgtggcgttcacggcaac

SEQ ID NO: 39249 - DNA, 23 bp, Homo sapiens
ctggtgctgctgctcgtcatcct

SEQ ID NO: 39250 - DNA, 23 bp, Homo sapiens
gccgtgatcctgtggtttcagct

SEQ ID NO: 39251 - DNA, 23 bp, Homo sapiens
gagcagcagcagcagcagcagca

SEQ ID NO: 39252 - DNA, 25 bp, Homo sapiens
atggaatgaacccgagcaatggaga

SEQ ID NO: 39253 - DNA, 24 bp, Homo sapiens
gaagattgtggcgttcacggcaac

SEQ ID NO: 39254 - DNA, 23 bp, Homo sapiens
ctggtgctgctgctcgtcatcct

SEQ ID NO: 39255 - DNA, 24 bp, Homo sapiens
gatgttccagaccaagttcaaggc

SEQ ID NO: 39256 - DNA, 23 bp, Homo sapiens
tgctggtgctgctgctcgtcatc

SEQ ID NO: 39257 - DNA, 24 bp, Homo sapiens
gaagattgtggcgttcacggcaac

SEQ ID NO: 39258 - DNA, 23 bp, Homo sapiens
aggatgttccagaccaagttcaa

SEQ ID NO: 39259 - DNA, 24 bp, Homo sapiens
agaaagaaaaggaaaaatcaagtc

SEQ ID NO: 39260 - DNA, 24 bp, Homo sapiens
aagaaagaaaaggaaaaatcaagt

SEQ ID NO: 39261 - DNA, 24 bp, Homo sapiens
gaagaaagaaaaggaaaaatcaag

SEQ ID NO: 39262 - DNA, 23 bp, Homo sapiens
gcatatgtctggagagcaggcca

SEQ ID NO: 39263 - DNA, 24 bp, Homo sapiens
aaagcagaaacctttatttgccaa

SEQ ID NO: 39264 - DNA, 23 bp, Homo sapiens
cattattttcacaaacaatgaaa

SEQ ID NO: 39265 - DNA, 24 bp, Homo sapiens
cttgtctgtgcttactggagtggc

SEQ ID NO: 39266 - DNA, 25 bp, Homo sapiens
atgatctcggctcaccacaatctcc

SEQ ID NO: 39267 - DNA, 23 bp, Homo sapiens
tggtcaggctggtctcgaactcc

SEQ ID NO: 39268 - DNA, 25 bp, Homo sapiens
tcaagtgaatctcctgcctcagcct

SEQ ID NO: 39269 - DNA, 23 bp, Homo sapiens
gggtccatttgagggtgagcgtg

SEQ ID NO: 39270 - DNA, 23 bp, Homo sapiens
gctttctgcctgtctgcctgccg

SEQ ID NO: 39271 - DNA, 23 bp, Homo sapiens
atgggctcctgggctgctgtgaa

SEQ ID NO: 39272 - DNA, 23 bp, Homo sapiens
gacctgcctgtgacctttgccct

SEQ ID NO: 39273 - DNA, 25 bp, Homo sapiens
tcagtttccagaagagccaaagcat

SEQ ID NO: 39274 - DNA, 24 bp, Homo sapiens
tctcactcaatgtaagtaaaattt

SEQ ID NO: 39275 - DNA, 24 bp, Homo sapiens
ttctcactcaatgtaagtaaaatt

SEQ ID NO: 39276 - DNA, 24 bp, Homo sapiens
attctcactcaatgtaagtaaaat

SEQ ID NO: 39277 - DNA, 24 bp, Homo sapiens
catttatttaggaaaagaagatat

SEQ ID NO: 39278 - DNA, 24 bp, Homo sapiens
gcatttatttaggaaaagaagata

SEQ ID NO: 39279 - DNA, 24 bp, Homo sapiens
tgcatttatttaggaaaagaagat

SEQ ID NO: 39280 - DNA, 24 bp, Homo sapiens
ctcccgtcgccctacagcaagatc

SEQ ID NO: 39281 - DNA, 24 bp, Homo sapiens
gttctaccacagcggcggcagcag

SEQ ID NO: 39282 - DNA, 24 bp, Homo sapiens
gactccacgagcgagaacagcagc

SEQ ID NO: 39283 - DNA, 23 bp, Homo sapiens
gagtcttcccttcccgccagtga

SEQ ID NO: 39284 - DNA, 23 bp, Homo sapiens
ccagatgatgaatttcgggctgc

SEQ ID NO: 39285 - DNA, 23 bp, Homo sapiens
agcagatccgcccgcccttcatc

SEQ ID NO: 39286 - DNA, 24 bp, Homo sapiens
caactttagcgataccaaaataat

SEQ ID NO: 39287 - DNA, 24 bp, Homo sapiens
acaactttagcgataccaaaataa

SEQ ID NO: 39288 - DNA, 24 bp, Homo sapiens
cacaactttagcgataccaaaata

SEQ ID NO: 39289 - DNA, 24 bp, Homo sapiens
aaccatatcaggtacaagtaataa

SEQ ID NO: 39290 - DNA, 24 bp, Homo sapiens
gaaccatatcaggtacaagtaata

SEQ ID NO: 39291 - DNA, 24 bp, Homo sapiens
tgaaccatatcaggtacaagtaat

SEQ ID NO: 39292 - DNA, 24 bp, Homo sapiens
aaaaaagaaagaaaaccgtgaaga

SEQ ID NO: 39293 - DNA, 24 bp, Homo sapiens
caaaaaagaaagaaaaccgtgaag

SEQ ID NO: 39294 - DNA, 24 bp, Homo sapiens
tcaaaaaagaaagaaaaccgtgaa

SEQ ID NO: 39295 - DNA, 25 bp, Homo sapiens
ttataatcatgctgcttgctgtggc

SEQ ID NO: 39296 - DNA, 25 bp, Homo sapiens
aaacagccaaggaaggagggtcttt

SEQ ID NO: 39297 - DNA, 25 bp, Homo sapiens
ttggagcaatgtcaagctacctctt

SEQ ID NO: 39298 - DNA, 24 bp, Homo sapiens
atactttttatggtctttgattta

SEQ ID NO: 39299 - DNA, 24 bp, Homo sapiens
catactttttatggtctttgattt

SEQ ID NO: 39300 - DNA, 24 bp, Homo sapiens
tcatactttttatggtctttgatt

SEQ ID NO: 39301 - DNA, 24 bp, Homo sapiens
taaaaatttaggtgatttacaaga

SEQ ID NO: 39302 - DNA, 24 bp, Homo sapiens
ttaaaaatttaggtgatttacaag

SEQ ID NO: 39303 - DNA, 24 bp, Homo sapiens
cttaaaaatttaggtgatttacaa

SEQ ID NO: 39304 - DNA, 23 bp, Homo sapiens
ggggcgagagattttgtggagcg

SEQ ID NO: 39305 - DNA, 25 bp, Homo sapiens
ttgttgtgactgctgccttgtatat

SEQ ID NO: 39306 - DNA, 23 bp, Homo sapiens
cctcgccctcctcccactgacat

SEQ ID NO: 39307 - DNA, 24 bp, Homo sapiens
tggatgaagaggatcttagtgaat

SEQ ID NO: 39308 - DNA, 24 bp, Homo sapiens
atggatgaagaggatcttagtgaa

SEQ ID NO: 39309 - DNA, 24 bp, Homo sapiens
tatggatgaagaggatcttagtga

SEQ ID NO: 39310 - DNA, 24 bp, Homo sapiens
aaaccagaaaggtaattcgacagc

SEQ ID NO: 39311 - DNA, 24 bp, Homo sapiens
aaaaccagaaaggtaattcgacag

SEQ ID NO: 39312 - DNA, 24 bp, Homo sapiens
aaaaaccagaaaggtaattcgaca

SEQ ID NO: 39313 - DNA, 24 bp, Homo sapiens
ttaaaattcaggctttcattaaag

SEQ ID NO: 39314 - DNA, 24 bp, Homo sapiens
tttaaaattcaggctttcattaaa

SEQ ID NO: 39315 - DNA, 24 bp, Homo sapiens
ttttaaaattcaggctttcattaa

SEQ ID NO: 39316 - DNA, 24 bp, Homo sapiens
agcatgaccagcatcagcttctga

SEQ ID NO: 39317 - DNA, 24 bp, Homo sapiens
gagcatgaccagcatcagcttctg

SEQ ID NO: 39318 - DNA, 24 bp, Homo sapiens
agagcatgaccagcatcagcttct

SEQ ID NO: 39319 - DNA, 23 bp, Homo sapiens
catcagttggagcaggagcaggc

SEQ ID NO: 39320 - DNA, 25 bp, Homo sapiens
ccagcaacctactgtaatgaaccag

SEQ ID NO: 39321 - DNA, 23 bp, Homo sapiens
cctatgatggcaccaaggctcgc

SEQ ID NO: 39322 - DNA, 23 bp, Homo sapiens
cctcgtgcggcacttgtctgtct

SEQ ID NO: 39323 - DNA, 23 bp, Homo sapiens
aagccccgcatccctctgtggtt

SEQ ID NO: 39324 - DNA, 23 bp, Homo sapiens
gagccagccccggccccaaccct

SEQ ID NO: 39325 - DNA, 23 bp, Homo sapiens
cggagccatgcggtacaacgaga

SEQ ID NO: 39326 - DNA, 23 bp, Homo sapiens
tgcaggctctgtcccggcagccg

SEQ ID NO: 39327 - DNA, 23 bp, Homo sapiens
atggcggccgagctgggcatgag

SEQ ID NO: 39328 - DNA, 25 bp, Homo sapiens
gcaacggcacaatcacaactcactg

SEQ ID NO: 39329 - DNA, 23 bp, Homo sapiens
cgttctcggctacaaggaaggcg

SEQ ID NO: 39330 - DNA, 24 bp, Homo sapiens
cgacctcctggactcaagcgatct

SEQ ID NO: 39331 - DNA, 24 bp, Homo sapiens
gagccatgcggtacaacgagaagg

SEQ ID NO: 39332 - DNA, 23 bp, Homo sapiens
cccagcctgagcggggacggcgg

SEQ ID NO: 39333 - DNA, 23 bp, Homo sapiens
gagatggcggccgagctgggcat

SEQ ID NO: 39334 - DNA, 23 bp, Homo sapiens
agcgatgtagtagctgccaggct

SEQ ID NO: 39335 - DNA, 23 bp, Homo sapiens
ttcaaccgcatgaagcagctggc

SEQ ID NO: 39336 - DNA, 23 bp, Homo sapiens
ccgccgccaccgccgccatgaag

SEQ ID NO: 39337 - DNA, 24 bp, Homo sapiens
gataatttcttagctgagaaaaca

SEQ ID NO: 39338 - DNA, 24 bp, Homo sapiens
tgataatttcttagctgagaaaac

SEQ ID NO: 39339 - DNA, 24 bp, Homo sapiens
atgataatttcttagctgagaaaa

SEQ ID NO: 39340 - DNA, 23 bp, Homo sapiens
cttagctcactgcaacctccgcc

SEQ ID NO: 39341 - DNA, 24 bp, Homo sapiens
caagttgtgtagtgtgctattttg

SEQ ID NO: 39342 - DNA, 24 bp, Homo sapiens
gcaagttgtgtagtgtgctatttt

SEQ ID NO: 39343 - DNA, 24 bp, Homo sapiens
tgcaagttgtgtagtgtgctattt

SEQ ID NO: 39344 - DNA, 23 bp, Homo sapiens
cagagatgtggctgctgaggctg

SEQ ID NO: 39345 - DNA, 25 bp, Homo sapiens
gatgccctcattgaaatggaccctg

SEQ ID NO: 39346 - DNA, 25 bp, Homo sapiens
ggctctggacgctactctatctaca

SEQ ID NO: 39347 - DNA, 23 bp, Homo sapiens
cagagatgtggctgctgaggctg

SEQ ID NO: 39348 - DNA, 25 bp, Homo sapiens
ctacattgccaattacgcctacggt

SEQ ID NO: 39349 - DNA, 25 bp, Homo sapiens
gccctgatgccctcattgaaatgga

SEQ ID NO: 39350 - DNA, 23 bp, Homo sapiens
agagatgtggctgctgaggctgg

SEQ ID NO: 39351 - DNA, 25 bp, Homo sapiens
gatgccctcattgaaatggaccctg

SEQ ID NO: 39352 - DNA, 25 bp, Homo sapiens
ggctctggacgctactctatctaca

SEQ ID NO: 39353 - DNA, 24 bp, Homo sapiens
ggtagaacacagcttcagaaacta

SEQ ID NO: 39354 - DNA, 24 bp, Homo sapiens
aggtagaacacagcttcagaaact

SEQ ID NO: 39355 - DNA, 24 bp, Homo sapiens
taggtagaacacagcttcagaaac

SEQ ID NO: 39356 - DNA, 24 bp, Homo sapiens
cagcttcccaggtatgcggccgga

SEQ ID NO: 39357 - DNA, 24 bp, Homo sapiens
ccagcttcccaggtatgcggccgg

SEQ ID NO: 39358 - DNA, 24 bp, Homo sapiens
cccagcttcccaggtatgcggccg

SEQ ID NO: 39359 - DNA, 24 bp, Homo sapiens
agaactggaagaatcacatgggtc

SEQ ID NO: 39360 - DNA, 24 bp, Homo sapiens
aagaactggaagaatcacatgggt

SEQ ID NO: 39361 - DNA, 24 bp, Homo sapiens
gaagaactggaagaatcacatggg

SEQ ID NO: 39362 - DNA, 24 bp, Homo sapiens
tgccagttaaggtttttgctgagt

SEQ ID NO: 39363 - DNA, 24 bp, Homo sapiens
ttgccagttaaggtttttgctgag

SEQ ID NO: 39364 - DNA, 24 bp, Homo sapiens
gttgccagttaaggtttttgctga

SEQ ID NO: 39365 - DNA, 24 bp, Homo sapiens
tttttaaagggaaaatcacaagat

SEQ ID NO: 39366 - DNA, 24 bp, Homo sapiens
gtttttaaagggaaaatcacaaga

SEQ ID NO: 39367 - DNA, 24 bp, Homo sapiens
tgtttttaaagggaaaatcacaag

SEQ ID NO: 39368 - DNA, 23 bp, Homo sapiens
ttgccatacctgataagccacgg

SEQ ID NO: 39369 - DNA, 23 bp, Homo sapiens
tggaggcactcaagcagcagcaa

SEQ ID NO: 39370 - DNA, 25 bp, Homo sapiens
accgagaacctgaaggaggaaccaa

SEQ ID NO: 39371 - DNA, 24 bp, Homo sapiens
ttttaaatggtggcaaaacagatg

SEQ ID NO: 39372 - DNA, 24 bp, Homo sapiens
tttttaaatggtggcaaaacagat

SEQ ID NO: 39373 - DNA, 24 bp, Homo sapiens
atttttaaatggtggcaaaacaga

SEQ ID NO: 39374 - DNA, 24 bp, Homo sapiens
tctcttttcagtgaatattacttc

SEQ ID NO: 39375 - DNA, 24 bp, Homo sapiens
ttctcttttcagtgaatattactt

SEQ ID NO: 39376 - DNA, 24 bp, Homo sapiens
tttctcttttcagtgaatattact

SEQ ID NO: 39377 - DNA, 23 bp, Homo sapiens
aggaccagcacctccagttactg

SEQ ID NO: 39378 - DNA, 24 bp, Homo sapiens
gcgggacttctgctcaaatcctgt

SEQ ID NO: 39379 - DNA, 24 bp, Homo sapiens
gcttgaaaaggaggagaattgggg

SEQ ID NO: 39380 - DNA, 24 bp, Homo sapiens
gaatgcctcaggatgagcaacaaa

SEQ ID NO: 39381 - DNA, 24 bp, Homo sapiens
tgaatgcctcaggatgagcaacaa

SEQ ID NO: 39382 - DNA, 24 bp, Homo sapiens
gtgaatgcctcaggatgagcaaca

SEQ ID NO: 39383 - DNA, 24 bp, Homo sapiens
acaattggcagaatacaatgattt

SEQ ID NO: 39384 - DNA, 24 bp, Homo sapiens
cacaattggcagaatacaatgatt

SEQ ID NO: 39385 - DNA, 24 bp, Homo sapiens
gcacaattggcagaatacaatgat

SEQ ID NO: 39386 - DNA, 24 bp, Homo sapiens
aaccctagcaggtaagactagaaa

SEQ ID NO: 39387 - DNA, 24 bp, Homo sapiens
aaaccctagcaggtaagactagaa

SEQ ID NO: 39388 - DNA, 24 bp, Homo sapiens
aaaaccctagcaggtaagactaga

SEQ ID NO: 39389 - DNA, 24 bp, Homo sapiens
tcttcaatctgccctgccaaggta

SEQ ID NO: 39390 - DNA, 24 bp, Homo sapiens
atcttcaatctgccctgccaaggt

SEQ ID NO: 39391 - DNA, 24 bp, Homo sapiens
catcttcaatctgccctgccaagg

SEQ ID NO: 39392 - DNA, 24 bp, Homo sapiens
tctgaatgcctgcaagaagctgcc

SEQ ID NO: 39393 - DNA, 23 bp, Homo sapiens
attgaaatcaaagttaaaacagc

SEQ ID NO: 39394 - DNA, 24 bp, Homo sapiens
gggcagccgaggtgtgtagctggg

SEQ ID NO: 39395 - DNA, 24 bp, Homo sapiens
cgggcagccgaggtgtgtagctgg

SEQ ID NO: 39396 - DNA, 24 bp, Homo sapiens
ccgggcagccgaggtgtgtagctg

SEQ ID NO: 39397 - DNA, 24 bp, Homo sapiens
tgcagataaaggaatttttaccat

SEQ ID NO: 39398 - DNA, 24 bp, Homo sapiens
atgcagataaaggaatttttacca

SEQ ID NO: 39399 - DNA, 24 bp, Homo sapiens
gatgcagataaaggaatttttacc

SEQ ID NO: 39400 - DNA, 24 bp, Homo sapiens
aacaaataaaggttgaatctgcat

SEQ ID NO: 39401 - DNA, 24 bp, Homo sapiens
aaacaaataaaggttgaatctgca

SEQ ID NO: 39402 - DNA, 24 bp, Homo sapiens
aaaacaaataaaggttgaatctgc

SEQ ID NO: 39403 - DNA, 23 bp, Homo sapiens
gcctcaagtgatctgcctgcctt

SEQ ID NO: 39404 - DNA, 23 bp, Homo sapiens
gcaccaccacgcctggctaatat

SEQ ID NO: 39405 - DNA, 23 bp, Homo sapiens
gtttaggagaggcggggttttgc

SEQ ID NO: 39406 - DNA, 25 bp, Homo sapiens
cctggtccctctccttgaagaatgg

SEQ ID NO: 39407 - DNA, 25 bp, Homo sapiens
aacatacagtttgctataccaagga

SEQ ID NO: 39408 - DNA, 23 bp, Homo sapiens
taacagagcgagactgtctaaaa

SEQ ID NO: 39409 - DNA, 24 bp, Homo sapiens
cattactacaggtatgaaatttga

SEQ ID NO: 39410 - DNA, 24 bp, Homo sapiens
gcattactacaggtatgaaatttg

SEQ ID NO: 39411 - DNA, 24 bp, Homo sapiens
ggcattactacaggtatgaaattt

SEQ ID NO: 39412 - DNA, 25 bp, Homo sapiens
ccctaaggacatctttgattggcga

SEQ ID NO: 39413 - DNA, 25 bp, Homo sapiens
gcccagtcccagaaacaaatctcag

SEQ ID NO: 39414 - DNA, 25 bp, Homo sapiens
tgaaggtacaataagtagagccagg

SEQ ID NO: 39415 - DNA, 24 bp, Homo sapiens
gtgcggtggctcactcctgtaatc

SEQ ID NO: 39416 - DNA, 25 bp, Homo sapiens
atctggaagaactggtaagtgttgc

SEQ ID NO: 39417 - DNA, 25 bp, Homo sapiens
aggaagcactttcacatctcatttg

SEQ ID NO: 39418 - DNA, 24 bp, Homo sapiens
gtgaggctgaggtgcagcatgtct

SEQ ID NO: 39419 - DNA, 24 bp, Homo sapiens
cgtgaggctgaggtgcagcatgtc

SEQ ID NO: 39420 - DNA, 24 bp, Homo sapiens
tcgtgaggctgaggtgcagcatgt

SEQ ID NO: 39421 - DNA, 23 bp, Homo sapiens
cgattcttgtgcctcagcctccg

SEQ ID NO: 39422 - DNA, 25 bp, Homo sapiens
gcccattctatcctatgctgcttcc

SEQ ID NO: 39423 - DNA, 25 bp, Homo sapiens
aaggacactcccactgttgtgctat

SEQ ID NO: 39424 - DNA, 24 bp, Homo sapiens
cggaacctgtgctcagatgacacc

SEQ ID NO: 39425 - DNA, 24 bp, Homo sapiens
caaggtgctggagctggacaacgt

SEQ ID NO: 39426 - DNA, 24 bp, Homo sapiens
cggtggaggcgtgcgtgaacatcg

SEQ ID NO: 39427 - DNA, 24 bp, Homo sapiens
gatttccagtgaatttgttgttcg

SEQ ID NO: 39428 - DNA, 24 bp, Homo sapiens
agatttccagtgaatttgttgttc

SEQ ID NO: 39429 - DNA, 24 bp, Homo sapiens
gagatttccagtgaatttgttgtt

SEQ ID NO: 39430 - DNA, 25 bp, Homo sapiens
tcacctgagatactgtgtcacctgt

SEQ ID NO: 39431 - DNA, 23 bp, Homo sapiens
ccctcctccgcccactcagaaag

SEQ ID NO: 39432 - DNA, 23 bp, Homo sapiens
gatgtggtcgctggaatctctgg

SEQ ID NO: 39433 - DNA, 24 bp, Homo sapiens
tccttttgtagactgtcctgagtg

SEQ ID NO: 39434 - DNA, 24 bp, Homo sapiens
ttccttttgtagactgtcctgagt

SEQ ID NO: 39435 - DNA, 24 bp, Homo sapiens
tttccttttgtagactgtcctgag

SEQ ID NO: 39436 - DNA, 24 bp, Homo sapiens
agcagaatcagatttagaatttaa

SEQ ID NO: 39437 - DNA, 24 bp, Homo sapiens
aagcagaatcagatttagaattta

SEQ ID NO: 39438 - DNA, 24 bp, Homo sapiens
caagcagaatcagatttagaattt

SEQ ID NO: 39439 - DNA, 23 bp, Homo sapiens
ggagatcatcaccaacgcctcgg

SEQ ID NO: 39440 - DNA, 24 bp, Homo sapiens
cagggtggatctcgtgactatggt

SEQ ID NO: 39441 - DNA, 25 bp, Homo sapiens
agaacggtgggatttacttgctggc

SEQ ID NO: 39442 - DNA, 23 bp, Homo sapiens
gaggacgacgacgaggacgagga

SEQ ID NO: 39443 - DNA, 23 bp, Homo sapiens
ctcgtcatcagcatctcgtgggc

SEQ ID NO: 39444 - DNA, 23 bp, Homo sapiens
gggacccccgcagcagcaccctg

SEQ ID NO: 39445 - DNA, 23 bp, Homo sapiens
agactcctgagccagcgagaagc

SEQ ID NO: 39446 - DNA, 24 bp, Homo sapiens
gcttgaacccattgacttgccacg

SEQ ID NO: 39447 - DNA, 25 bp, Homo sapiens
agacttcatattcactggcaagact

SEQ ID NO: 39448 - DNA, 24 bp, Homo sapiens
aaagacaagaggaaattcaaagaa

SEQ ID NO: 39449 - DNA, 24 bp, Homo sapiens
aaaagacaagaggaaattcaaaga

SEQ ID NO: 39450 - DNA, 24 bp, Homo sapiens
taaaagacaagaggaaattcaaag

SEQ ID NO: 39451 - DNA, 24 bp, Homo sapiens
tttcttcccagataaaacaataaa

SEQ ID NO: 39452 - DNA, 24 bp, Homo sapiens
ttttcttcccagataaaacaataa

SEQ ID NO: 39453 - DNA, 24 bp, Homo sapiens
attttcttcccagataaaacaata

SEQ ID NO: 39454 - DNA, 23 bp, Homo sapiens
ccgacactctgccaccttctcca

SEQ ID NO: 39455 - DNA, 23 bp, Homo sapiens
accgtggagacaacctggagacc

SEQ ID NO: 39456 - DNA, 24 bp, Homo sapiens
ccttctgttggaccctgcctctca

SEQ ID NO: 39457 - DNA, 23 bp, Homo sapiens
gaagatggcggcggtggctggat

SEQ ID NO: 39458 - DNA, 23 bp, Homo sapiens
gctcactgctcctcgtggtgggc

SEQ ID NO: 39459 - DNA, 23 bp, Homo sapiens
cccggggctcctcacctacgtcc

SEQ ID NO: 39460 - DNA, 23 bp, Homo sapiens
gacgacagcagcagcagccacag

SEQ ID NO: 39461 - DNA, 23 bp, Homo sapiens
gtaacatggaagccgccgccgcc

SEQ ID NO: 39462 - DNA, 23 bp, Homo sapiens
gaacaaaggtcatccgagctgcg

SEQ ID NO: 39463 - DNA, 23 bp, Homo sapiens
gacagcagcagcagccacagcag

SEQ ID NO: 39464 - DNA, 23 bp, Homo sapiens
gaacaaaggtcatccgagctgcg

SEQ ID NO: 39465 - DNA, 23 bp, Homo sapiens
catggaagccgccgccgccgccg

SEQ ID NO: 39466 - DNA, 24 bp, Homo sapiens
gcaacacagcacacacctacaagc

SEQ ID NO: 39467 - DNA, 24 bp, Homo sapiens
gaagaaccaaacccaagaagcgga

SEQ ID NO: 39468 - DNA, 24 bp, Homo sapiens
cggaagtccttgcggatgaagaat

SEQ ID NO: 39469 - DNA, 25 bp, Homo sapiens
acagcacattccagagccatgaacc

SEQ ID NO: 39470 - DNA, 24 bp, Homo sapiens
aagtcagcgagcgtgataagaggc

SEQ ID NO: 39471 - DNA, 23 bp, Homo sapiens
atcctgccaccatcacaaccctg

SEQ ID NO: 39472 - DNA, 23 bp, Homo sapiens
ggacttccagcctccagaactgt

SEQ ID NO: 39473 - DNA, 25 bp, Homo sapiens
ctccttagaaagaagactattgggc

SEQ ID NO: 39474 - DNA, 25 bp, Homo sapiens
gaagagagtcctcatcagacaccaa

SEQ ID NO: 39475 - DNA, 24 bp, Homo sapiens
gccctatttacacacagaatgagc

SEQ ID NO: 39476 - DNA, 25 bp, Homo sapiens
gacttcgctgttattaaaccttcaa

SEQ ID NO: 39477 - DNA, 23 bp, Homo sapiens
tgattgtaagtttcctgagacct

SEQ ID NO: 39478 - DNA, 24 bp, Homo sapiens
tatatcataagctgacattatctc

SEQ ID NO: 39479 - DNA, 24 bp, Homo sapiens
ttatatcataagctgacattatct

SEQ ID NO: 39480 - DNA, 24 bp, Homo sapiens
attatatcataagctgacattatc

SEQ ID NO: 39481 - DNA, 24 bp, Homo sapiens
ttatattacagacccatgaataca

SEQ ID NO: 39482 - DNA, 24 bp, Homo sapiens
attatattacagacccatgaatac

SEQ ID NO: 39483 - DNA, 24 bp, Homo sapiens
tattatattacagacccatgaata

SEQ ID NO: 39484 - DNA, 24 bp, Homo sapiens
ttcttgcatacatggagtggttta

SEQ ID NO: 39485 - DNA, 24 bp, Homo sapiens
attcttgcatacatggagtggttt

SEQ ID NO: 39486 - DNA, 24 bp, Homo sapiens
aattcttgcatacatggagtggtt

SEQ ID NO: 39487 - DNA, 24 bp, Homo sapiens
ccaacgaatgctggaaggagcctc

SEQ ID NO: 39488 - DNA, 25 bp, Homo sapiens
tggatgctaagactgtgactgcctc

SEQ ID NO: 39489 - DNA, 23 bp, Homo sapiens
gtgtgctgtggctctgtggttca

SEQ ID NO: 39490 - DNA, 24 bp, Homo sapiens
tcttgtcataggtgaacctgatgc

SEQ ID NO: 39491 - DNA, 24 bp, Homo sapiens
atcttgtcataggtgaacctgatg

SEQ ID NO: 39492 - DNA, 24 bp, Homo sapiens
aatcttgtcataggtgaacctgat

SEQ ID NO: 39493 - DNA, 24 bp, Homo sapiens
ttatggaaaaggtgtactgagtgg

SEQ ID NO: 39494 - DNA, 24 bp, Homo sapiens
cttatggaaaaggtgtactgagtg

SEQ ID NO: 39495 - DNA, 24 bp, Homo sapiens
gcttatggaaaaggtgtactgagt

SEQ ID NO: 39496 - DNA, 25 bp, Homo sapiens
aacctgatctgctgcctcctctgaa

SEQ ID NO: 39497 - DNA, 25 bp, Homo sapiens
accactggattatctgctgtgttgt

SEQ ID NO: 39498 - DNA, 24 bp, Homo sapiens
ggaggaagaggaggaggaagaggc

SEQ ID NO: 39499 - DNA, 25 bp, Homo sapiens
tgaattagaagattttccagtactt

SEQ ID NO: 39500 - DNA, 25 bp, Homo sapiens
cgcttctccttcctgctgttcactt

SEQ ID NO: 39501 - DNA, 23 bp, Homo sapiens
acaggtgtggtggctgcggatgg

SEQ ID NO: 39502 - DNA, 23 bp, Homo sapiens
tcatctgcatgtgtgacagcggc

SEQ ID NO: 39503 - DNA, 23 bp, Homo sapiens
caagacagcgagcgggaacacac

SEQ ID NO: 39504 - DNA, 23 bp, Homo sapiens
gcacgagcagcatcaggtcaccg

SEQ ID NO: 39505 - DNA, 24 bp, Homo sapiens
gcttctctgcttcttctgcgacga

SEQ ID NO: 39506 - DNA, 25 bp, Homo sapiens
caccattgtggcttacggcaacttg

SEQ ID NO: 39507 - DNA, 23 bp, Homo sapiens
gaggtggtggtggcggagaagac

SEQ ID NO: 39508 - DNA, 23 bp, Homo sapiens
cacacgaagccgcaagccgcaag

SEQ ID NO: 39509 - DNA, 23 bp, Homo sapiens
ggtcgcagccttatcttcagagc

SEQ ID NO: 39510 - DNA, 23 bp, Homo sapiens
ataagcagcagcaaagccagcca

SEQ ID NO: 39511 - DNA, 24 bp, Homo sapiens
acggtgggaatggcagaaggaaat

SEQ ID NO: 39512 - DNA, 24 bp, Homo sapiens
gtgcttatcatgtgtcatctttaa

SEQ ID NO: 39513 - DNA, 24 bp, Homo sapiens
tgtgcttatcatgtgtcatcttta

SEQ ID NO: 39514 - DNA, 24 bp, Homo sapiens
gtgtgcttatcatgtgtcatcttt

SEQ ID NO: 39515 - DNA, 25 bp, Homo sapiens
acattccacggttctactttcctga

SEQ ID NO: 39516 - DNA, 25 bp, Homo sapiens
ccatgtgaataatgttgtgaatgcg

SEQ ID NO: 39517 - DNA, 24 bp, Homo sapiens
cacctccagccacctctccaagta

SEQ ID NO: 39518 - DNA, 24 bp, Homo sapiens
aaattgcaaaggttgctgaataac

SEQ ID NO: 39519 - DNA, 24 bp, Homo sapiens
aaaattgcaaaggttgctgaataa

SEQ ID NO: 39520 - DNA, 24 bp, Homo sapiens
gaaaattgcaaaggttgctgaata

SEQ ID NO: 39521 - DNA, 24 bp, Homo sapiens
tctctttctaggggatgaactgac

SEQ ID NO: 39522 - DNA, 24 bp, Homo sapiens
atctctttctaggggatgaactga

SEQ ID NO: 39523 - DNA, 24 bp, Homo sapiens
gatctctttctaggggatgaactg

SEQ ID NO: 39524 - DNA, 23 bp, Homo sapiens
ctcagagcctggacggtggagag

SEQ ID NO: 39525 - DNA, 23 bp, Homo sapiens
gtgctgctgaggacacaggtgcg

SEQ ID NO: 39526 - DNA, 23 bp, Homo sapiens
ctgccctggacctggtgtggaac

SEQ ID NO: 39527 - DNA, 23 bp, Homo sapiens
ctgccctggacctggtgtggaac

SEQ ID NO: 39528 - DNA, 23 bp, Homo sapiens
cggctccctgaggcagagagttg

SEQ ID NO: 39529 - DNA, 24 bp, Homo sapiens
cccgtggagaagattgaaattgcc

SEQ ID NO: 39530 - DNA, 25 bp, Homo sapiens
gatgatggatgatgctgtcctctgc

SEQ ID NO: 39531 - DNA, 25 bp, Homo sapiens
tcaaggtgtggaagattcagagtgg

SEQ ID NO: 39532 - DNA, 25 bp, Homo sapiens
atttgagagggcacacagtaagggt

SEQ ID NO: 39533 - DNA, 24 bp, Homo sapiens
tttctcccacggtaataatgaaat

SEQ ID NO: 39534 - DNA, 24 bp, Homo sapiens
atttctcccacggtaataatgaaa

SEQ ID NO: 39535 - DNA, 24 bp, Homo sapiens
aatttctcccacggtaataatgaa

SEQ ID NO: 39536 - DNA, 24 bp, Homo sapiens
ggcttcctggatggctgtgttcaa

SEQ ID NO: 39537 - DNA, 25 bp, Homo sapiens
cgtcacagccatcgttatcatcaag

SEQ ID NO: 39538 - DNA, 25 bp, Homo sapiens
acacagaccgcaagttcaccatcag

SEQ ID NO: 39539 - DNA, 24 bp, Homo sapiens
tggctgtgaaggctgggagccaga

SEQ ID NO: 39540 - DNA, 24 bp, Homo sapiens
gtggctgtgaaggctgggagccag

SEQ ID NO: 39541 - DNA, 24 bp, Homo sapiens
tgtggctgtgaaggctgggagcca

SEQ ID NO: 39542 - DNA, 24 bp, Homo sapiens
ctgtcatgcaggctggagtgcggt

SEQ ID NO: 39543 - DNA, 24 bp, Homo sapiens
tctgtcatgcaggctggagtgcgg

SEQ ID NO: 39544 - DNA, 24 bp, Homo sapiens
ctctgtcatgcaggctggagtgcg

SEQ ID NO: 39545 - DNA, 24 bp, Homo sapiens
acagtaaatgggtaaagtccttta

SEQ ID NO: 39546 - DNA, 24 bp, Homo sapiens
tacagtaaatgggtaaagtccttt

SEQ ID NO: 39547 - DNA, 24 bp, Homo sapiens
atacagtaaatgggtaaagtcctt

SEQ ID NO: 39548 - DNA, 23 bp, Homo sapiens
gccgtggctcacacctgtaatcc

SEQ ID NO: 39549 - DNA, 25 bp, Homo sapiens
ctgaaccacagagaggtattcctgg

SEQ ID NO: 39550 - DNA, 25 bp, Homo sapiens
gcttcagaatggcatcctcagacag

SEQ ID NO: 39551 - DNA, 25 bp, Homo sapiens
aagcaatcctctcaccttgacctcc

SEQ ID NO: 39552 - DNA, 25 bp, Homo sapiens
aggttgaagtgcagtggtgtgatga

SEQ ID NO: 39553 - DNA, 23 bp, Homo sapiens
ggtcttcctccagttccgcctga

SEQ ID NO: 39554 - DNA, 25 bp, Homo sapiens
cgccattgattacctcctcttctct

SEQ ID NO: 39555 - DNA, 23 bp, Homo sapiens
gcctgtgagagtgcctgttccag

SEQ ID NO: 39556 - DNA, 24 bp, Homo sapiens
tgtttgaaactgtgagtaatgatc

SEQ ID NO: 39557 - DNA, 24 bp, Homo sapiens
ctgtttgaaactgtgagtaatgat

SEQ ID NO: 39558 - DNA, 24 bp, Homo sapiens
tctgtttgaaactgtgagtaatga

SEQ ID NO: 39559 - DNA, 24 bp, Homo sapiens
tggaagagaagttgactaagataa

SEQ ID NO: 39560 - DNA, 24 bp, Homo sapiens
ctggaagagaagttgactaagata

SEQ ID NO: 39561 - DNA, 24 bp, Homo sapiens
actggaagagaagttgactaagat

SEQ ID NO: 39562 - DNA, 24 bp, Homo sapiens
ggcaacagaatggactctcgctct

SEQ ID NO: 39563 - DNA, 23 bp, Homo sapiens
agggattctcctgctcagcctcc

SEQ ID NO: 39564 - DNA, 23 bp, Homo sapiens
ctcactgcaacctccgcctccag

SEQ ID NO: 39565 - DNA, 24 bp, Homo sapiens
aaagaaatcagaaagatgtgccgg

SEQ ID NO: 39566 - DNA, 24 bp, Homo sapiens
aaaagaaatcagaaagatgtgccg

SEQ ID NO: 39567 - DNA, 24 bp, Homo sapiens
taaaagaaatcagaaagatgtgcc

SEQ ID NO: 39568 - DNA, 25 bp, Homo sapiens
tctcttggacaaacactgtgaggaa

SEQ ID NO: 39569 - DNA, 24 bp, Homo sapiens
gatttgtaaacatccatttggaca

SEQ ID NO: 39570 - DNA, 25 bp, Homo sapiens
ctgtgaatgttagtgtataaaaatt

SEQ ID NO: 39571 - DNA, 24 bp, Homo sapiens
aaattttgcagtgtttaactgttc

SEQ ID NO: 39572 - DNA, 24 bp, Homo sapiens
taaattttgcagtgtttaactgtt

SEQ ID NO: 39573 - DNA, 24 bp, Homo sapiens
ataaattttgcagtgtttaactgt

SEQ ID NO: 39574 - DNA, 24 bp, Homo sapiens
gatgactacagatttgagttttgt

SEQ ID NO: 39575 - DNA, 24 bp, Homo sapiens
agatgactacagatttgagttttg

SEQ ID NO: 39576 - DNA, 24 bp, Homo sapiens
tagatgactacagatttgagtttt

SEQ ID NO: 39577 - DNA, 24 bp, Homo sapiens
caaagaactgaatttgagttttgt

SEQ ID NO: 39578 - DNA, 24 bp, Homo sapiens
gcaaagaactgaatttgagttttg

SEQ ID NO: 39579 - DNA, 24 bp, Homo sapiens
ggcaaagaactgaatttgagtttt

SEQ ID NO: 39580 - DNA, 24 bp, Homo sapiens
cagcagcccagcactccccggtgc

SEQ ID NO: 39581 - DNA, 24 bp, Homo sapiens
gcagcagcccagcactccccggtg

SEQ ID NO: 39582 - DNA, 24 bp, Homo sapiens
ggcagcagcccagcactccccggt

SEQ ID NO: 39583 - DNA, 24 bp, Homo sapiens
aagcaaaaaaggaacactgtcatc

SEQ ID NO: 39584 - DNA, 24 bp, Homo sapiens
aaagcaaaaaaggaacactgtcat

SEQ ID NO: 39585 - DNA, 24 bp, Homo sapiens
caaagcaaaaaaggaacactgtca

SEQ ID NO: 39586 - DNA, 24 bp, Homo sapiens
ttttcatttaggaacactgtcatc

SEQ ID NO: 39587 - DNA, 24 bp, Homo sapiens
attttcatttaggaacactgtcat

SEQ ID NO: 39588 - DNA, 24 bp, Homo sapiens
tattttcatttaggaacactgtca

SEQ ID NO: 39589 - DNA, 24 bp, Homo sapiens
gctgctacaagaggaggaggagag

SEQ ID NO: 39590 - DNA, 25 bp, Homo sapiens
aagaggaagaggaagcccgtttgaa

SEQ ID NO: 39591 - DNA, 25 bp, Homo sapiens
gtcatcacaaacaggcttcagtggc

SEQ ID NO: 39592 - DNA, 23 bp, Homo sapiens
ttcaaggacacgccgctggaagg

SEQ ID NO: 39593 - DNA, 23 bp, Homo sapiens
ggtggtgctaaccgacctcaagg

SEQ ID NO: 39594 - DNA, 23 bp, Homo sapiens
tgctgctgctcttcgccatcttc

SEQ ID NO: 39595 - DNA, 24 bp, Homo sapiens
tcctgccccaggcccccattgccg

SEQ ID NO: 39596 - DNA, 24 bp, Homo sapiens
atcctgccccaggcccccattgcc

SEQ ID NO: 39597 - DNA, 24 bp, Homo sapiens
gatcctgccccaggcccccattgc

SEQ ID NO: 39598 - DNA, 24 bp, Homo sapiens
ccgacacagagaacaggaggaact

SEQ ID NO: 39599 - DNA, 23 bp, Homo sapiens
atgaagaggagcatcggcggcgt

SEQ ID NO: 39600 - DNA, 25 bp, Homo sapiens
actcagacgcttggaagaactcaga

SEQ ID NO: 39601 - DNA, 24 bp, Homo sapiens
cttgccagagaagctgatgcagaa

SEQ ID NO: 39602 - DNA, 25 bp, Homo sapiens
ggaacccatggagcagtttgatgat

SEQ ID NO: 39603 - DNA, 23 bp, Homo sapiens
gcagcagcgtgagcaggttgata

SEQ ID NO: 39604 - DNA, 25 bp, Homo sapiens
ggaagcagctaggcatgaacaccaa

SEQ ID NO: 39605 - DNA, 24 bp, Homo sapiens
gcatctcgatggaaggctcttgat

SEQ ID NO: 39606 - DNA, 23 bp, Homo sapiens
caggagtcggagtcggagtcgtg

SEQ ID NO: 39607 - DNA, 23 bp, Homo sapiens
aggcgctctcgctttgatttcgg

SEQ ID NO: 39608 - DNA, 23 bp, Homo sapiens
cctcgcggggagagattggctgc

SEQ ID NO: 39609 - DNA, 25 bp, Homo sapiens
gtgatagcgttgccatgaaggaagc

SEQ ID NO: 39610 - DNA, 25 bp, Homo sapiens
aattcctggactcaagcactcctcc

SEQ ID NO: 39611 - DNA, 25 bp, Homo sapiens
ggagtcttgctttgtcaccaggttg

SEQ ID NO: 39612 - DNA, 24 bp, Homo sapiens
ttatttttcagatagaccacatgg

SEQ ID NO: 39613 - DNA, 24 bp, Homo sapiens
cttatttttcagatagaccacatg

SEQ ID NO: 39614 - DNA, 24 bp, Homo sapiens
tcttatttttcagatagaccacat

SEQ ID NO: 39615 - DNA, 23 bp, Homo sapiens
gtcgcaagaggtggagtccgttc

SEQ ID NO: 39616 - DNA, 23 bp, Homo sapiens
ctgttctgggtgcctgtgcctca

SEQ ID NO: 39617 - DNA, 24 bp, Homo sapiens
aggcagcagggcactcaatcagta

SEQ ID NO: 39618 - DNA, 23 bp, Homo sapiens
ctgttctgggtgcctgtgcctca

SEQ ID NO: 39619 - DNA, 23 bp, Homo sapiens
gtcgcaagaggtggagtccgttc

SEQ ID NO: 39620 - DNA, 25 bp, Homo sapiens
tctcaggaccttgatgatcttgcca

SEQ ID NO: 39621 - DNA, 24 bp, Homo sapiens
tgctgccaccatgtaagaagtgcc

SEQ ID NO: 39622 - DNA, 23 bp, Homo sapiens
cctccaccatgattatgagacct

SEQ ID NO: 39623 - DNA, 23 bp, Homo sapiens
tggctgtgaatccgtctggtcct

SEQ ID NO: 39624 - DNA, 25 bp, Homo sapiens
aaatgcgttagggaggattccgtct

SEQ ID NO: 39625 - DNA, 23 bp, Homo sapiens
accagctcctctttgtacctctg

SEQ ID NO: 39626 - DNA, 23 bp, Homo sapiens
atagaagccatggaggcagcagg

SEQ ID NO: 39627 - DNA, 25 bp, Homo sapiens
tcagtactcttttcctatgtggagg

SEQ ID NO: 39628 - DNA, 23 bp, Homo sapiens
caagaatcccctttttgtgcaaa

SEQ ID NO: 39629 - DNA, 25 bp, Homo sapiens
cctgcctattggacactaccagtca

SEQ ID NO: 39630 - DNA, 25 bp, Homo sapiens
tcagcagaggtggtagaagaggtgg

SEQ ID NO: 39631 - DNA, 23 bp, Homo sapiens
ggcacaggagcagcagatagagc

SEQ ID NO: 39632 - DNA, 24 bp, Homo sapiens
tgactatccaggtaagcatctcag

SEQ ID NO: 39633 - DNA, 24 bp, Homo sapiens
gtgactatccaggtaagcatctca

SEQ ID NO: 39634 - DNA, 24 bp, Homo sapiens
ggtgactatccaggtaagcatctc

SEQ ID NO: 39635 - DNA, 24 bp, Homo sapiens
aaatatctcaggtaacaagtcgat

SEQ ID NO: 39636 - DNA, 24 bp, Homo sapiens
gaaatatctcaggtaacaagtcga

SEQ ID NO: 39637 - DNA, 24 bp, Homo sapiens
agaaatatctcaggtaacaagtcg

SEQ ID NO: 39638 - DNA, 24 bp, Homo sapiens
atttacaacagcttctggagctat

SEQ ID NO: 39639 - DNA, 24 bp, Homo sapiens
catttacaacagcttctggagcta

SEQ ID NO: 39640 - DNA, 24 bp, Homo sapiens
tcatttacaacagcttctggagct

SEQ ID NO: 39641 - DNA, 23 bp, Homo sapiens
atcactgctgcgactttcctggc

SEQ ID NO: 39642 - DNA, 23 bp, Homo sapiens
ctgtgctgctgcggatggctgag

SEQ ID NO: 39643 - DNA, 25 bp, Homo sapiens
gcctggttacgagttctgagacttg

SEQ ID NO: 39644 - DNA, 24 bp, Homo sapiens
gcagccagaagcggcaggcagtgt

SEQ ID NO: 39645 - DNA, 24 bp, Homo sapiens
tgcagccagaagcggcaggcagtg

SEQ ID NO: 39646 - DNA, 24 bp, Homo sapiens
gtgcagccagaagcggcaggcagt

SEQ ID NO: 39647 - DNA, 24 bp, Homo sapiens
ggctcctgacgtgtatcgaacctc

SEQ ID NO: 39648 - DNA, 25 bp, Homo sapiens
agttcatccatcgcaagaagaagat

SEQ ID NO: 39649 - DNA, 24 bp, Homo sapiens
aattgttcgcctgagcagagacca

SEQ ID NO: 39650 - DNA, 24 bp, Homo sapiens
aaccagaacagtggttaaatgagg

SEQ ID NO: 39651 - DNA, 24 bp, Homo sapiens
aaaccagaacagtggttaaatgag

SEQ ID NO: 39652 - DNA, 24 bp, Homo sapiens
aaaaccagaacagtggttaaatga

SEQ ID NO: 39653 - DNA, 25 bp, Homo sapiens
gctcctcgatgttgtgctgactatt

SEQ ID NO: 39654 - DNA, 23 bp, Homo sapiens
ccagccacagcaccagcctcctg

SEQ ID NO: 39655 - DNA, 23 bp, Homo sapiens
gcacacaaggtcgtcctggctgc

SEQ ID NO: 39656 - DNA, 25 bp, Homo sapiens
gctcctcgatgttgtgctgactatt

SEQ ID NO: 39657 - DNA, 23 bp, Homo sapiens
cacccagccacagcaccagcctc

SEQ ID NO: 39658 - DNA, 23 bp, Homo sapiens
gcacacaaggtcgtcctggctgc

SEQ ID NO: 39659 - DNA, 24 bp, Homo sapiens
atacataagaggtaaatttttaat

SEQ ID NO: 39660 - DNA, 24 bp, Homo sapiens
catacataagaggtaaatttttaa

SEQ ID NO: 39661 - DNA, 24 bp, Homo sapiens
tcatacataagaggtaaattttta

SEQ ID NO: 39662 - DNA, 24 bp, Homo sapiens
ttcaatgtatgggtattgtgtcac

SEQ ID NO: 39663 - DNA, 24 bp, Homo sapiens
tttcaatgtatgggtattgtgtca

SEQ ID NO: 39664 - DNA, 24 bp, Homo sapiens
ttttcaatgtatgggtattgtgtc

SEQ ID NO: 39665 - DNA, 24 bp, Homo sapiens
ttctccttcagttctacagcgagt

SEQ ID NO: 39666 - DNA, 24 bp, Homo sapiens
attctccttcagttctacagcgag

SEQ ID NO: 39667 - DNA, 24 bp, Homo sapiens
tattctccttcagttctacagcga

SEQ ID NO: 39668 - DNA, 24 bp, Homo sapiens
atatctttcaggctttcaaattca

SEQ ID NO: 39669 - DNA, 24 bp, Homo sapiens
catatctttcaggctttcaaattc

SEQ ID NO: 39670 - DNA, 24 bp, Homo sapiens
ccatatctttcaggctttcaaatt

SEQ ID NO: 39671 - DNA, 23 bp, Homo sapiens
ctccaccagccactgatgccagc

SEQ ID NO: 39672 - DNA, 25 bp, Homo sapiens
ccaaggacaacggcagaagtagaga

SEQ ID NO: 39673 - DNA, 24 bp, Homo sapiens
tctggtcacagtggtagtcgctgg

SEQ ID NO: 39674 - DNA, 24 bp, Homo sapiens
gagagagtgaggacaggctgcggg

SEQ ID NO: 39675 - DNA, 24 bp, Homo sapiens
tgagagagtgaggacaggctgcgg

SEQ ID NO: 39676 - DNA, 24 bp, Homo sapiens
ctgagagagtgaggacaggctgcg

SEQ ID NO: 39677 - DNA, 23 bp, Homo sapiens
ggtgcctcaggatgtgacgcagg

SEQ ID NO: 39678 - DNA, 24 bp, Homo sapiens
caggtggaaaggaggacagtggga

SEQ ID NO: 39679 - DNA, 23 bp, Homo sapiens
ctacaagcaggagcccagcagcc

SEQ ID NO: 39680 - DNA, 25 bp, Homo sapiens
ggttcaagtgattctcctgcctcgg

SEQ ID NO: 39681 - DNA, 25 bp, Homo sapiens
agtacagtggtgtgatctcggctca

SEQ ID NO: 39682 - DNA, 24 bp, Homo sapiens
gtcagagtgagggcaggtggtttg

SEQ ID NO: 39683 - DNA, 24 bp, Homo sapiens
ctttttttaagaaaaggaaagcga

SEQ ID NO: 39684 - DNA, 24 bp, Homo sapiens
tctttttttaagaaaaggaaagcg

SEQ ID NO: 39685 - DNA, 24 bp, Homo sapiens
ctctttttttaagaaaaggaaagc

SEQ ID NO: 39686 - DNA, 24 bp, Homo sapiens
ttgggcaacagggaacattgctgt

SEQ ID NO: 39687 - DNA, 24 bp, Homo sapiens
tttgggcaacagggaacattgctg

SEQ ID NO: 39688 - DNA, 24 bp, Homo sapiens
atttgggcaacagggaacattgct

SEQ ID NO: 39689 - DNA, 24 bp, Homo sapiens
aaggtggacacttcctcctggacc

SEQ ID NO: 39690 - DNA, 23 bp, Homo sapiens
atggtgatcctcagcggtgcctc

SEQ ID NO: 39691 - DNA, 24 bp, Homo sapiens
cttcagcagcagcatctacggcat

SEQ ID NO: 39692 - DNA, 23 bp, Homo sapiens
agcacgagtcacccgttctacga

SEQ ID NO: 39693 - DNA, 25 bp, Homo sapiens
atgaccgctttggaagacgtgttgt

SEQ ID NO: 39694 - DNA, 23 bp, Homo sapiens
gcggctgctggagtatttgaagt

SEQ ID NO: 39695 - DNA, 24 bp, Homo sapiens
aggctggagctgctggaggaagtt

SEQ ID NO: 39696 - DNA, 24 bp, Homo sapiens
caggctggagctgctggaggaagt

SEQ ID NO: 39697 - DNA, 24 bp, Homo sapiens
gcaggctggagctgctggaggaag

SEQ ID NO: 39698 - DNA, 24 bp, Homo sapiens
gaggcagtgaccacccaccctgga

SEQ ID NO: 39699 - DNA, 24 bp, Homo sapiens
ggaggcagtgaccacccaccctgg

SEQ ID NO: 39700 - DNA, 24 bp, Homo sapiens
cggaggcagtgaccacccaccctg

SEQ ID NO: 39701 - DNA, 23 bp, Homo sapiens
ccccgaagtgccttgcgcctcaa

SEQ ID NO: 39702 - DNA, 23 bp, Homo sapiens
ggcctggctcaccggagtaagaa

SEQ ID NO: 39703 - DNA, 23 bp, Homo sapiens
caggggcaacacattcagggcgg

SEQ ID NO: 39704 - DNA, 24 bp, Homo sapiens
atattaggagattagatagattca

SEQ ID NO: 39705 - DNA, 24 bp, Homo sapiens
gatattaggagattagatagattc

SEQ ID NO: 39706 - DNA, 24 bp, Homo sapiens
tgatattaggagattagatagatt

SEQ ID NO: 39707 - DNA, 24 bp, Homo sapiens
tatttttataactatccagcagtg

SEQ ID NO: 39708 - DNA, 24 bp, Homo sapiens
ttatttttataactatccagcagt

SEQ ID NO: 39709 - DNA, 24 bp, Homo sapiens
cttatttttataactatccagcag

SEQ ID NO: 39710 - DNA, 23 bp, Homo sapiens
ggaactgcggcagtctctccctg

SEQ ID NO: 39711 - DNA, 23 bp, Homo sapiens
cggcggcgtgcggccctctctcc

SEQ ID NO: 39712 - DNA, 23 bp, Homo sapiens
aggatacaccgtgggcctgaggc

SEQ ID NO: 39713 - DNA, 23 bp, Homo sapiens
ccctccttcccaatggcatctcc

SEQ ID NO: 39714 - DNA, 25 bp, Homo sapiens
tggaactgaagacactgagcaatgg

SEQ ID NO: 39715 - DNA, 24 bp, Homo sapiens
gagggtgtggagaatgcctgcttc

SEQ ID NO: 39716 - DNA, 24 bp, Homo sapiens
cgctttattcacatcaaatagtaa

SEQ ID NO: 39717 - DNA, 24 bp, Homo sapiens
gcgctttattcacatcaaatagta

SEQ ID NO: 39718 - DNA, 24 bp, Homo sapiens
tgcgctttattcacatcaaatagt

SEQ ID NO: 39719 - DNA, 23 bp, Homo sapiens
cttcctgcccgcccgcttctacc

SEQ ID NO: 39720 - DNA, 23 bp, Homo sapiens
gcatggtgctcttcttcttcgag

SEQ ID NO: 39721 - DNA, 23 bp, Homo sapiens
ggacgaccggctctactgcgtct

SEQ ID NO: 39722 - DNA, 24 bp, Homo sapiens
aaaatcatagaaaattagaagaaa

SEQ ID NO: 39723 - DNA, 24 bp, Homo sapiens
aaaaatcatagaaaattagaagaa

SEQ ID NO: 39724 - DNA, 24 bp, Homo sapiens
gaaaaatcatagaaaattagaaga

SEQ ID NO: 39725 - DNA, 25 bp, Homo sapiens
tgaaggaattagtgctacaggctgc

SEQ ID NO: 39726 - DNA, 25 bp, Homo sapiens
tgaagagcgtcgccaacaattcctt

SEQ ID NO: 39727 - DNA, 25 bp, Homo sapiens
gcagcaaaggcggcaaggatttatt

SEQ ID NO: 39728 - DNA, 24 bp, Homo sapiens
ttctcttaaagggaatacagtgag

SEQ ID NO: 39729 - DNA, 24 bp, Homo sapiens
tttctcttaaagggaatacagtga

SEQ ID NO: 39730 - DNA, 24 bp, Homo sapiens
ttttctcttaaagggaatacagtg

SEQ ID NO: 39731 - DNA, 24 bp, Homo sapiens
aatggtttcagccactagaactta

SEQ ID NO: 39732 - DNA, 24 bp, Homo sapiens
aaatggtttcagccactagaactt

SEQ ID NO: 39733 - DNA, 24 bp, Homo sapiens
caaatggtttcagccactagaact

SEQ ID NO: 39734 - DNA, 24 bp, Homo sapiens
gtggctcccagcttgtagacaaaa

SEQ ID NO: 39735 - DNA, 24 bp, Homo sapiens
ggtggctcccagcttgtagacaaa

SEQ ID NO: 39736 - DNA, 24 bp, Homo sapiens
cggtggctcccagcttgtagacaa

SEQ ID NO: 39737 - DNA, 23 bp, Homo sapiens
cagcactgagccgcaccaacctc

SEQ ID NO: 39738 - DNA, 24 bp, Homo sapiens
ggcgtggagtatgtcaagaatggc

SEQ ID NO: 39739 - DNA, 25 bp, Homo sapiens
aggaggtgattctgagtggaggtgc

SEQ ID NO: 39740 - DNA, 25 bp, Homo sapiens
ttcctggtcaatctgtggtactcct

SEQ ID NO: 39741 - DNA, 23 bp, Homo sapiens
ttcatggtggtggacctgctcct

SEQ ID NO: 39742 - DNA, 25 bp, Homo sapiens
tccacagagacatcaagccagacaa

SEQ ID NO: 39743 - DNA, 23 bp, Homo sapiens
atcactctgctgctgcttctacc

SEQ ID NO: 39744 - DNA, 25 bp, Homo sapiens
ggaatgtcaccttctctaggactgc

SEQ ID NO: 39745 - DNA, 24 bp, Homo sapiens
gttctaccatcagctccaagtgtg

SEQ ID NO: 39746 - DNA, 23 bp, Homo sapiens
cgagcggcagccactgttggatc

SEQ ID NO: 39747 - DNA, 23 bp, Homo sapiens
ctctccgccaggctcgccgggcc

SEQ ID NO: 39748 - DNA, 23 bp, Homo sapiens
cgagtggcggcggcggccggctc

SEQ ID NO: 39749 - DNA, 23 bp, Homo sapiens
ttgagcggttggtggtgctggat

SEQ ID NO: 39750 - DNA, 25 bp, Homo sapiens
agcagaacctcttcctgagaacact

SEQ ID NO: 39751 - DNA, 24 bp, Homo sapiens
gccattgaccgagtgaagtccagg

SEQ ID NO: 39752 - DNA, 25 bp, Homo sapiens
aaagcccgtcctagccttaaagagc

SEQ ID NO: 39753 - DNA, 25 bp, Homo sapiens
aacctggagaccttagacttgagtt

SEQ ID NO: 39754 - DNA, 23 bp, Homo sapiens
cgctgaccctggctctcaacaag

SEQ ID NO: 39755 - DNA, 24 bp, Homo sapiens
cttcaacagcctggagacactgcc

SEQ ID NO: 39756 - DNA, 24 bp, Homo sapiens
gctcttgctgtctcacaactgcct

SEQ ID NO: 39757 - DNA, 23 bp, Homo sapiens
cccgccctcaccttcctcacagt

SEQ ID NO: 39758 - DNA, 25 bp, Homo sapiens
cctctccttggcacccttgaatctg

SEQ ID NO: 39759 - DNA, 23 bp, Homo sapiens
ctgctgagtgtggctgggcgtct

SEQ ID NO: 39760 - DNA, 23 bp, Homo sapiens
gggtgtcctaccgggaggtgcag

SEQ ID NO: 39761 - DNA, 24 bp, Homo sapiens
ctagacctggacaagtatgtggaa

SEQ ID NO: 39762 - DNA, 24 bp, Homo sapiens
ccgctgccgccgccgctgctacag

SEQ ID NO: 39763 - DNA, 24 bp, Homo sapiens
ccgcggcttgttattcttaaaatg

SEQ ID NO: 39764 - DNA, 24 bp, Homo sapiens
ctaaattacaggttcgtttctttc

SEQ ID NO: 39765 - DNA, 24 bp, Homo sapiens
tctaaattacaggttcgtttcttt

SEQ ID NO: 39766 - DNA, 24 bp, Homo sapiens
atctaaattacaggttcgtttctt

SEQ ID NO: 39767 - DNA, 24 bp, Homo sapiens
ctgtggctcttggctgtggctctc

SEQ ID NO: 39768 - DNA, 24 bp, Homo sapiens
tggacctgcgcttctcgggcgctg

SEQ ID NO: 39769 - DNA, 25 bp, Homo sapiens
atgatgacgatgatgatgatgatgg

SEQ ID NO: 39770 - DNA, 24 bp, Homo sapiens
ccataataggtcctgcattgccac

SEQ ID NO: 39771 - DNA, 25 bp, Homo sapiens
ggcagagatgatccaggacaacagg

SEQ ID NO: 39772 - DNA, 24 bp, Homo sapiens
tcgaagtagtagtaagttttttaa

SEQ ID NO: 39773 - DNA, 24 bp, Homo sapiens
ttcgaagtagtagtaagtttttta

SEQ ID NO: 39774 - DNA, 24 bp, Homo sapiens
tttcgaagtagtagtaagtttttt

SEQ ID NO: 39775 - DNA, 24 bp, Homo sapiens
cctgagaaaaggtaatattgatct

SEQ ID NO: 39776 - DNA, 24 bp, Homo sapiens
tcctgagaaaaggtaatattgatc

SEQ ID NO: 39777 - DNA, 24 bp, Homo sapiens
atcctgagaaaaggtaatattgat

SEQ ID NO: 39778 - DNA, 23 bp, Homo sapiens
cagcagcggcggaaacaccagat

SEQ ID NO: 39779 - DNA, 24 bp, Homo sapiens
tgattcagaagatgatttttggcg

SEQ ID NO: 39780 - DNA, 24 bp, Homo sapiens
atgattcagaagatgatttttggc

SEQ ID NO: 39781 - DNA, 24 bp, Homo sapiens
catgattcagaagatgatttttgg

SEQ ID NO: 39782 - DNA, 25 bp, Homo sapiens
gggagggaacacagacacagcttat

SEQ ID NO: 39783 - DNA, 23 bp, Homo sapiens
tctgctgtggtccttcggtgtga

SEQ ID NO: 39784 - DNA, 23 bp, Homo sapiens
gcagcatacccatctccaacccg

SEQ ID NO: 39785 - DNA, 24 bp, Homo sapiens
ttatgtttcagatatgagcaagac

SEQ ID NO: 39786 - DNA, 24 bp, Homo sapiens
attatgtttcagatatgagcaaga

SEQ ID NO: 39787 - DNA, 24 bp, Homo sapiens
tattatgtttcagatatgagcaag

SEQ ID NO: 39788 - DNA, 24 bp, Homo sapiens
catccattcagcaaattcagcaaa

SEQ ID NO: 39789 - DNA, 24 bp, Homo sapiens
tcatccattcagcaaattcagcaa

SEQ ID NO: 39790 - DNA, 24 bp, Homo sapiens
ttcatccattcagcaaattcagca

SEQ ID NO: 39791 - DNA, 25 bp, Homo sapiens
gcagaaaggagtgatgaatcagccc

SEQ ID NO: 39792 - DNA, 23 bp, Homo sapiens
gcacacctgagcgaagaccagaa

SEQ ID NO: 39793 - DNA, 23 bp, Homo sapiens
agcaacagcagcagcagcagcag

SEQ ID NO: 39794 - DNA, 24 bp, Homo sapiens
ataaagttctggtaaagtatacat

SEQ ID NO: 39795 - DNA, 24 bp, Homo sapiens
gataaagttctggtaaagtataca

SEQ ID NO: 39796 - DNA, 24 bp, Homo sapiens
tgataaagttctggtaaagtatac

SEQ ID NO: 39797 - DNA, 25 bp, Homo sapiens
catcaacattgtagacactggaggc

SEQ ID NO: 39798 - DNA, 24 bp, Homo sapiens
agcctcttccttcaggactcacct

SEQ ID NO: 39799 - DNA, 25 bp, Homo sapiens
tgagatggagtcttgttctgttgcc

SEQ ID NO: 39800 - DNA, 23 bp, Homo sapiens
cgcagccaccgcaacgacatcat

SEQ ID NO: 39801 - DNA, 23 bp, Homo sapiens
gcccagagcaactacggaccacg

SEQ ID NO: 39802 - DNA, 23 bp, Homo sapiens
catggcaagtggctctctacgag

SEQ ID NO: 39803 - DNA, 24 bp, Homo sapiens
agtttctgaaggagtgtgctgggg

SEQ ID NO: 39804 - DNA, 24 bp, Homo sapiens
aagtttctgaaggagtgtgctggg

SEQ ID NO: 39805 - DNA, 24 bp, Homo sapiens
taagtttctgaaggagtgtgctgg

SEQ ID NO: 39806 - DNA, 23 bp, Homo sapiens
agaacctacctcagccgcagtcg

SEQ ID NO: 39807 - DNA, 24 bp, Homo sapiens
aagaactatgagtgcgtggtgcgg

SEQ ID NO: 39808 - DNA, 23 bp, Homo sapiens
ggtcatgcagcctcttaccttgc

SEQ ID NO: 39809 - DNA, 24 bp, Homo sapiens
ccgcctcaactacactgtgctgat

SEQ ID NO: 39810 - DNA, 23 bp, Homo sapiens
cgtgttcgctcactgtctcggac

SEQ ID NO: 39811 - DNA, 23 bp, Homo sapiens
cctgtcatggtgctggtgggtgg

SEQ ID NO: 39812 - DNA, 23 bp, Homo sapiens
gctgactaaccacatggacgagg

SEQ ID NO: 39813 - DNA, 23 bp, Homo sapiens
gacaacctggagtcccgtgtggc

SEQ ID NO: 39814 - DNA, 23 bp, Homo sapiens
cctgtcatggtgctggtgggtgg

SEQ ID NO: 39815 - DNA, 23 bp, Homo sapiens
tggtcgccgagattgtactggtc

SEQ ID NO: 39816 - DNA, 23 bp, Homo sapiens
cagtgtgctcaatcgctcgcctc

SEQ ID NO: 39817 - DNA, 25 bp, Homo sapiens
atctccttgaatcgctctctcccag

SEQ ID NO: 39818 - DNA, 24 bp, Homo sapiens
ttattttgcagtgataaagaatta

SEQ ID NO: 39819 - DNA, 24 bp, Homo sapiens
tttattttgcagtgataaagaatt

SEQ ID NO: 39820 - DNA, 24 bp, Homo sapiens
atttattttgcagtgataaagaat

SEQ ID NO: 39821 - DNA, 24 bp, Homo sapiens
tgttcctgaaacaattcatgatga

SEQ ID NO: 39822 - DNA, 24 bp, Homo sapiens
ttgttcctgaaacaattcatgatg

SEQ ID NO: 39823 - DNA, 24 bp, Homo sapiens
cttgttcctgaaacaattcatgat

SEQ ID NO: 39824 - DNA, 24 bp, Homo sapiens
aaggattcaatgtgagtatttaaa

SEQ ID NO: 39825 - DNA, 24 bp, Homo sapiens
aaaggattcaatgtgagtatttaa

SEQ ID NO: 39826 - DNA, 24 bp, Homo sapiens
gaaaggattcaatgtgagtattta

SEQ ID NO: 39827 - DNA, 24 bp, Homo sapiens
atatgaataaggaattgtcatttc

SEQ ID NO: 39828 - DNA, 24 bp, Homo sapiens
gatatgaataaggaattgtcattt

SEQ ID NO: 39829 - DNA, 24 bp, Homo sapiens
tgatatgaataaggaattgtcatt

SEQ ID NO: 39830 - DNA, 25 bp, Homo sapiens
ggtgtgaagcagaagtgtctctaca

SEQ ID NO: 39831 - DNA, 24 bp, Homo sapiens
ttcaagaggaacctggaaggctgc

SEQ ID NO: 39832 - DNA, 23 bp, Homo sapiens
ggacggcgtgtgagatgtgctgg

SEQ ID NO: 39833 - DNA, 24 bp, Homo sapiens
ctctgcagcagcagcaacagcagc

SEQ ID NO: 39834 - DNA, 24 bp, Homo sapiens
actctgcagcagcagcaacagcag

SEQ ID NO: 39835 - DNA, 24 bp, Homo sapiens
cactctgcagcagcagcaacagca

SEQ ID NO: 39836 - DNA, 25 bp, Homo sapiens
cccaccaatcaaacttccctcaagc

SEQ ID NO: 39837 - DNA, 25 bp, Homo sapiens
tcggtattggggaagggtgtaaaac

SEQ ID NO: 39838 - DNA, 25 bp, Homo sapiens
acaacagacaagcagctttctcaaa

SEQ ID NO: 39839 - DNA, 24 bp, Homo sapiens
ttatttttaaggaaaacttagaag

SEQ ID NO: 39840 - DNA, 24 bp, Homo sapiens
attatttttaaggaaaacttagaa

SEQ ID NO: 39841 - DNA, 24 bp, Homo sapiens
cattatttttaaggaaaacttaga

SEQ ID NO: 39842 - DNA, 24 bp, Homo sapiens
agattgatttgctttctaccaaat

SEQ ID NO: 39843 - DNA, 24 bp, Homo sapiens
cagattgatttgctttctaccaaa

SEQ ID NO: 39844 - DNA, 24 bp, Homo sapiens
tcagattgatttgctttctaccaa

SEQ ID NO: 39845 - DNA, 24 bp, Homo sapiens
caccgtgttgcccaggctggtctc

SEQ ID NO: 39846 - DNA, 24 bp, Homo sapiens
tagagttaaatgaaaacttagaag

SEQ ID NO: 39847 - DNA, 24 bp, Homo sapiens
atagagttaaatgaaaacttagaa

SEQ ID NO: 39848 - DNA, 24 bp, Homo sapiens
gatagagttaaatgaaaacttaga

SEQ ID NO: 39849 - DNA, 24 bp, Homo sapiens
gttatatctaggaagaacatgttc

SEQ ID NO: 39850 - DNA, 24 bp, Homo sapiens
tgttatatctaggaagaacatgtt

SEQ ID NO: 39851 - DNA, 24 bp, Homo sapiens
ctgttatatctaggaagaacatgt

SEQ ID NO: 39852 - DNA, 24 bp, Homo sapiens
ctctcaggatgaaggtgacggtgg

SEQ ID NO: 39853 - DNA, 24 bp, Homo sapiens
agacagtggacttcgtcaggagca

SEQ ID NO: 39854 - DNA, 24 bp, Homo sapiens
ctccttccatgccttccagacagc

SEQ ID NO: 39855 - DNA, 23 bp, Homo sapiens
gcagcaacagcaacaggacttcg

SEQ ID NO: 39856 - DNA, 23 bp, Homo sapiens
cagccgcaaccgccagcacaact

SEQ ID NO: 39857 - DNA, 24 bp, Homo sapiens
tgtatcgggtcctagttcggctgg

SEQ ID NO: 39858 - DNA, 24 bp, Homo sapiens
atattgtcgaggtagaaaatattt

SEQ ID NO: 39859 - DNA, 24 bp, Homo sapiens
aatattgtcgaggtagaaaatatt

SEQ ID NO: 39860 - DNA, 24 bp, Homo sapiens
gaatattgtcgaggtagaaaatat

SEQ ID NO: 39861 - DNA, 24 bp, Homo sapiens
ctctttttcagccgtgttgaaatc

SEQ ID NO: 39862 - DNA, 24 bp, Homo sapiens
tctctttttcagccgtgttgaaat

SEQ ID NO: 39863 - DNA, 24 bp, Homo sapiens
gtctctttttcagccgtgttgaaa

SEQ ID NO: 39864 - DNA, 24 bp, Homo sapiens
ttttgccccagccatccagtattg

SEQ ID NO: 39865 - DNA, 24 bp, Homo sapiens
cttttgccccagccatccagtatt

SEQ ID NO: 39866 - DNA, 24 bp, Homo sapiens
tcttttgccccagccatccagtat

SEQ ID NO: 39867 - DNA, 24 bp, Homo sapiens
tagggcttttgaaatggagtttga

SEQ ID NO: 39868 - DNA, 24 bp, Homo sapiens
ctagggcttttgaaatggagtttg

SEQ ID NO: 39869 - DNA, 24 bp, Homo sapiens
tctagggcttttgaaatggagttt

SEQ ID NO: 39870 - DNA, 23 bp, Homo sapiens
cccgcagacgccccagcctactg

SEQ ID NO: 39871 - DNA, 23 bp, Homo sapiens
aacatggctggagcgcggcggag

SEQ ID NO: 39872 - DNA, 23 bp, Homo sapiens
ccgccgccagcatgttgggcgcc

SEQ ID NO: 39873 - DNA, 23 bp, Homo sapiens
atctcctgacctcgtgatccgcc

SEQ ID NO: 39874 - DNA, 24 bp, Homo sapiens
ggattacaggcatgaaccaccgct

SEQ ID NO: 39875 - DNA, 24 bp, Homo sapiens
gcctacacctctaactgctggaga

SEQ ID NO: 39876 - DNA, 23 bp, Homo sapiens
ggcagcgactccgaaggtgttaa

SEQ ID NO: 39877 - DNA, 23 bp, Homo sapiens
aggaacctcagcagcagaagcag

SEQ ID NO: 39878 - DNA, 24 bp, Homo sapiens
ggcctatgatgaagccatcatggc

SEQ ID NO: 39879 - DNA, 24 bp, Homo sapiens
catttttgcagatatatcccaaga

SEQ ID NO: 39880 - DNA, 24 bp, Homo sapiens
tcatttttgcagatatatcccaag

SEQ ID NO: 39881 - DNA, 24 bp, Homo sapiens
ttcatttttgcagatatatcccaa

SEQ ID NO: 39882 - DNA, 25 bp, Homo sapiens
aggaacttgaacaaggagaaccact

SEQ ID NO: 39883 - DNA, 25 bp, Homo sapiens
ttaaagacacatccatagcatactt

SEQ ID NO: 39884 - DNA, 23 bp, Homo sapiens
aaaagctttcaaacaatattggt

SEQ ID NO: 39885 - DNA, 24 bp, Homo sapiens
aatccaaacagatttaaaggaagc

SEQ ID NO: 39886 - DNA, 24 bp, Homo sapiens
aaatccaaacagatttaaaggaag

SEQ ID NO: 39887 - DNA, 24 bp, Homo sapiens
caaatccaaacagatttaaaggaa

SEQ ID NO: 39888 - DNA, 24 bp, Homo sapiens
agttcactcaggctaaatttgatt

SEQ ID NO: 39889 - DNA, 24 bp, Homo sapiens
aagttcactcaggctaaatttgat

SEQ ID NO: 39890 - DNA, 24 bp, Homo sapiens
caagttcactcaggctaaatttga

SEQ ID NO: 39891 - DNA, 24 bp, Homo sapiens
ggttggcacagtaaatgaagcagg

SEQ ID NO: 39892 - DNA, 24 bp, Homo sapiens
tggttggcacagtaaatgaagcag

SEQ ID NO: 39893 - DNA, 24 bp, Homo sapiens
ttggttggcacagtaaatgaagca

SEQ ID NO: 39894 - DNA, 24 bp, Homo sapiens
agagcagagaggaacacctgagcc

SEQ ID NO: 39895 - DNA, 23 bp, Homo sapiens
tccaccagcaccaaggcaacaag

SEQ ID NO: 39896 - DNA, 25 bp, Homo sapiens
gaagtgtggagtcaagtatggctgc

SEQ ID NO: 39897 - DNA, 24 bp, Homo sapiens
gagtacctcaggatgtggagagca

SEQ ID NO: 39898 - DNA, 24 bp, Homo sapiens
tgagtacctcaggatgtggagagc

SEQ ID NO: 39899 - DNA, 24 bp, Homo sapiens
gtgagtacctcaggatgtggagag

SEQ ID NO: 39900 - DNA, 24 bp, Homo sapiens
tttatggatgtggctgctgggctg

SEQ ID NO: 39901 - DNA, 23 bp, Homo sapiens
gaatgttgctgctgctgtctcca

SEQ ID NO: 39902 - DNA, 25 bp, Homo sapiens
gactcaggcactttggacacggtag

SEQ ID NO: 39903 - DNA, 24 bp, Homo sapiens
tggaacttgaggaaaatgactcag

SEQ ID NO: 39904 - DNA, 24 bp, Homo sapiens
gtggaacttgaggaaaatgactca

SEQ ID NO: 39905 - DNA, 24 bp, Homo sapiens
ggtggaacttgaggaaaatgactc

SEQ ID NO: 39906 - DNA, 23 bp, Homo sapiens
gaatgttgctgctgctgtctcca

SEQ ID NO: 39907 - DNA, 24 bp, Homo sapiens
tttatggatgtggctgctgggctg

SEQ ID NO: 39908 - DNA, 25 bp, Homo sapiens
gagtacctcaggatgtggagagcat

SEQ ID NO: 39909 - DNA, 24 bp, Homo sapiens
tctagtgtgaggattctcctttta

SEQ ID NO: 39910 - DNA, 24 bp, Homo sapiens
ttctagtgtgaggattctcctttt

SEQ ID NO: 39911 - DNA, 24 bp, Homo sapiens
attctagtgtgaggattctccttt

SEQ ID NO: 39912 - DNA, 24 bp, Homo sapiens
cccacttacaaaacagcaatttcc

SEQ ID NO: 39913 - DNA, 24 bp, Homo sapiens
tcccacttacaaaacagcaatttc

SEQ ID NO: 39914 - DNA, 24 bp, Homo sapiens
gtcccacttacaaaacagcaattt

SEQ ID NO: 39915 - DNA, 24 bp, Homo sapiens
cggtggtggagctccgtgtcccga

SEQ ID NO: 39916 - DNA, 24 bp, Homo sapiens
acggtggtggagctccgtgtcccg

SEQ ID NO: 39917 - DNA, 24 bp, Homo sapiens
aacggtggtggagctccgtgtccc

SEQ ID NO: 39918 - DNA, 23 bp, Homo sapiens
caggaagctgccagtcagttcag

SEQ ID NO: 39919 - DNA, 23 bp, Homo sapiens
gcctcatctgtcttctcttccag

SEQ ID NO: 39920 - DNA, 23 bp, Homo sapiens
gatccacccacctcagcctccca

SEQ ID NO: 39921 - DNA, 24 bp, Homo sapiens
gcaatgaggcagacacaggctctt

SEQ ID NO: 39922 - DNA, 25 bp, Homo sapiens
acatctgtattggaacgcctgaaga

SEQ ID NO: 39923 - DNA, 25 bp, Homo sapiens
attgctgtcaagtaccacctcactg

SEQ ID NO: 39924 - DNA, 25 bp, Homo sapiens
gaagaaagcaacattgtccactggg

SEQ ID NO: 39925 - DNA, 25 bp, Homo sapiens
ttaatgaagagccaccagactatct

SEQ ID NO: 39926 - DNA, 25 bp, Homo sapiens
tgggaagttaagctaagaatgtgca

SEQ ID NO: 39927 - DNA, 23 bp, Homo sapiens
agcggtcactgatgcctccttca

SEQ ID NO: 39928 - DNA, 23 bp, Homo sapiens
caccgccagcaccgactcttcac

SEQ ID NO: 39929 - DNA, 25 bp, Homo sapiens
gagatgattcagaaaggtgagcagc

SEQ ID NO: 39930 - DNA, 24 bp, Homo sapiens
acagcttaacagaagaacaaaaat

SEQ ID NO: 39931 - DNA, 24 bp, Homo sapiens
aacagcttaacagaagaacaaaaa

SEQ ID NO: 39932 - DNA, 24 bp, Homo sapiens
caacagcttaacagaagaacaaaa

SEQ ID NO: 39933 - DNA, 24 bp, Homo sapiens
tctgcgacatgctcccggcgatgt

SEQ ID NO: 39934 - DNA, 24 bp, Homo sapiens
ctctgcgacatgctcccggcgatg

SEQ ID NO: 39935 - DNA, 24 bp, Homo sapiens
actctgcgacatgctcccggcgat

SEQ ID NO: 39936 - DNA, 23 bp, Homo sapiens
tcttgcttccacgccttgccgag

SEQ ID NO: 39937 - DNA, 23 bp, Homo sapiens
gttccagcagcacagcagcgagg

SEQ ID NO: 39938 - DNA, 23 bp, Homo sapiens
ccgagctgtcagccttgatgcag

SEQ ID NO: 39939 - DNA, 23 bp, Homo sapiens
cttcctgtttgagaacctcttca

SEQ ID NO: 39940 - DNA, 23 bp, Homo sapiens
gcctcagcccacagcccacctgg

SEQ ID NO: 39941 - DNA, 23 bp, Homo sapiens
ctggctatgctggccgggctcta

SEQ ID NO: 39942 - DNA, 24 bp, Homo sapiens
cttaatgtcaggtaaaaattaagc

SEQ ID NO: 39943 - DNA, 24 bp, Homo sapiens
acttaatgtcaggtaaaaattaag

SEQ ID NO: 39944 - DNA, 24 bp, Homo sapiens
aacttaatgtcaggtaaaaattaa

SEQ ID NO: 39945 - DNA, 24 bp, Homo sapiens
gatctactgaggtatgtattttga

SEQ ID NO: 39946 - DNA, 24 bp, Homo sapiens
agatctactgaggtatgtattttg

SEQ ID NO: 39947 - DNA, 24 bp, Homo sapiens
aagatctactgaggtatgtatttt

SEQ ID NO: 39948 - DNA, 24 bp, Homo sapiens
taaatctgtaggagagttccaaaa

SEQ ID NO: 39949 - DNA, 24 bp, Homo sapiens
ttaaatctgtaggagagttccaaa

SEQ ID NO: 39950 - DNA, 24 bp, Homo sapiens
tttaaatctgtaggagagttccaa

SEQ ID NO: 39951 - DNA, 23 bp, Homo sapiens
tagtcctcccacctttgcctccc

SEQ ID NO: 39952 - DNA, 23 bp, Homo sapiens
cagactggtcttgaactcctggt

SEQ ID NO: 39953 - DNA, 24 bp, Homo sapiens
ttgtagagatggacatcttgctat

SEQ ID NO: 39954 - DNA, 24 bp, Homo sapiens
ttgttttacagaagaggatgtgga

SEQ ID NO: 39955 - DNA, 24 bp, Homo sapiens
tttgttttacagaagaggatgtgg

SEQ ID NO: 39956 - DNA, 24 bp, Homo sapiens
ttttgttttacagaagaggatgtg

SEQ ID NO: 39957 - DNA, 24 bp, Homo sapiens
atggaatccaggataactacacct

SEQ ID NO: 39958 - DNA, 24 bp, Homo sapiens
gatggaatccaggataactacacc

SEQ ID NO: 39959 - DNA, 24 bp, Homo sapiens
ggatggaatccaggataactacac

SEQ ID NO: 39960 - DNA, 24 bp, Homo sapiens
tggagagtcctggatggcagatgg

SEQ ID NO: 39961 - DNA, 25 bp, Homo sapiens
ggtatctagttgcgaagcctgatgt

SEQ ID NO: 39962 - DNA, 23 bp, Homo sapiens
ctggaggagtggcagcaactgga

SEQ ID NO: 39963 - DNA, 24 bp, Homo sapiens
tctttttacagtggaatgaagtta

SEQ ID NO: 39964 - DNA, 24 bp, Homo sapiens
ttctttttacagtggaatgaagtt

SEQ ID NO: 39965 - DNA, 24 bp, Homo sapiens
cttctttttacagtggaatgaagt

SEQ ID NO: 39966 - DNA, 24 bp, Homo sapiens
aaacattttgggtatgtatagatt

SEQ ID NO: 39967 - DNA, 24 bp, Homo sapiens
taaacattttgggtatgtatagat

SEQ ID NO: 39968 - DNA, 24 bp, Homo sapiens
gtaaacattttgggtatgtataga

SEQ ID NO: 39969 - DNA, 24 bp, Homo sapiens
gttatgtaccaaagaatgcagatg

SEQ ID NO: 39970 - DNA, 24 bp, Homo sapiens
agttatgtaccaaagaatgcagat

SEQ ID NO: 39971 - DNA, 24 bp, Homo sapiens
aagttatgtaccaaagaatgcaga

SEQ ID NO: 39972 - DNA, 23 bp, Homo sapiens
cctaccagcagcagcagccacag

SEQ ID NO: 39973 - DNA, 23 bp, Homo sapiens
gtggcagtggtggcggtcagatg

SEQ ID NO: 39974 - DNA, 24 bp, Homo sapiens
gtctccgcactcgcagtatcacac

SEQ ID NO: 39975 - DNA, 24 bp, Homo sapiens
tgaacatccagattattcacaccg

SEQ ID NO: 39976 - DNA, 24 bp, Homo sapiens
gtgaacatccagattattcacacc

SEQ ID NO: 39977 - DNA, 24 bp, Homo sapiens
agtgaacatccagattattcacac

SEQ ID NO: 39978 - DNA, 24 bp, Homo sapiens
ttatattgtaggtaaattcaactg

SEQ ID NO: 39979 - DNA, 24 bp, Homo sapiens
tttatattgtaggtaaattcaact

SEQ ID NO: 39980 - DNA, 24 bp, Homo sapiens
atttatattgtaggtaaattcaac

SEQ ID NO: 39981 - DNA, 23 bp, Homo sapiens
ccagaaacgggttgcggacacgg

SEQ ID NO: 39982 - DNA, 23 bp, Homo sapiens
acccagaagggactgtgtccaaa

SEQ ID NO: 39983 - DNA, 23 bp, Homo sapiens
tgacagaaggcagcccccacgag

SEQ ID NO: 39984 - DNA, 24 bp, Homo sapiens
caatgataaagacaaagacaatag

SEQ ID NO: 39985 - DNA, 24 bp, Homo sapiens
ccaatgataaagacaaagacaata

SEQ ID NO: 39986 - DNA, 24 bp, Homo sapiens
accaatgataaagacaaagacaat

SEQ ID NO: 39987 - DNA, 24 bp, Homo sapiens
tgattcattagatcttcatcataa

SEQ ID NO: 39988 - DNA, 24 bp, Homo sapiens
ctgattcattagatcttcatcata

SEQ ID NO: 39989 - DNA, 24 bp, Homo sapiens
actgattcattagatcttcatcat

SEQ ID NO: 39990 - DNA, 24 bp, Homo sapiens
tccccagatgatagtgagcctgat

SEQ ID NO: 39991 - DNA, 24 bp, Homo sapiens
ctccccagatgatagtgagcctga

SEQ ID NO: 39992 - DNA, 24 bp, Homo sapiens
cctccccagatgatagtgagcctg

SEQ ID NO: 39993 - DNA, 24 bp, Homo sapiens
agtatttgaatcaccacaaaaagt

SEQ ID NO: 39994 - DNA, 24 bp, Homo sapiens
cagtatttgaatcaccacaaaaag

SEQ ID NO: 39995 - DNA, 24 bp, Homo sapiens
gcagtatttgaatcaccacaaaaa

SEQ ID NO: 39996 - DNA, 24 bp, Homo sapiens
tgacagacgaggtgaaagatctgg

SEQ ID NO: 39997 - DNA, 24 bp, Homo sapiens
atgacagacgaggtgaaagatctg

SEQ ID NO: 39998 - DNA, 24 bp, Homo sapiens
catgacagacgaggtgaaagatct

SEQ ID NO: 39999 - DNA, 24 bp, Homo sapiens
tccttgtccaggtaatcaaaagag

SEQ ID NO: 40000 - DNA, 24 bp, Homo sapiens
atccttgtccaggtaatcaaaaga

SEQ ID NO: 40001 - DNA, 24 bp, Homo sapiens
aatccttgtccaggtaatcaaaag

SEQ ID NO: 40002 - DNA, 24 bp, Homo sapiens
gaactaaacaggaaataaaaacag

SEQ ID NO: 40003 - DNA, 24 bp, Homo sapiens
agaactaaacaggaaataaaaaca

SEQ ID NO: 40004 - DNA, 24 bp, Homo sapiens
gagaactaaacaggaaataaaaac

SEQ ID NO: 40005 - DNA, 24 bp, Homo sapiens
ctcaatatcaggtaatacatgtga

SEQ ID NO: 40006 - DNA, 24 bp, Homo sapiens
cctcaatatcaggtaatacatgtg

SEQ ID NO: 40007 - DNA, 24 bp, Homo sapiens
tcctcaatatcaggtaatacatgt

SEQ ID NO: 40008 - DNA, 24 bp, Homo sapiens
aagtagcactggtagtatatcaaa

SEQ ID NO: 40009 - DNA, 24 bp, Homo sapiens
aaagtagcactggtagtatatcaa

SEQ ID NO: 40010 - DNA, 24 bp, Homo sapiens
aaaagtagcactggtagtatatca

SEQ ID NO: 40011 - DNA, 23 bp, Homo sapiens
tttcacttcataactaaattagt

SEQ ID NO: 40012 - DNA, 23 bp, Homo sapiens
tgttaatatttctaactttgaaa

SEQ ID NO: 40013 - DNA, 23 bp, Homo sapiens
atgcgccaccacacccggccaaa

SEQ ID NO: 40014 - DNA, 24 bp, Homo sapiens
gtttcttttagatgattttcagac

SEQ ID NO: 40015 - DNA, 24 bp, Homo sapiens
tgtttcttttagatgattttcaga

SEQ ID NO: 40016 - DNA, 24 bp, Homo sapiens
ttgtttcttttagatgattttcag

SEQ ID NO: 40017 - DNA, 24 bp, Homo sapiens
aaggaagaaattaaaagaaagtga

SEQ ID NO: 40018 - DNA, 24 bp, Homo sapiens
aaaggaagaaattaaaagaaagtg

SEQ ID NO: 40019 - DNA, 24 bp, Homo sapiens
gaaaggaagaaattaaaagaaagt

SEQ ID NO: 40020 - DNA, 24 bp, Homo sapiens
ttatctcacaggcaatctgaaggc

SEQ ID NO: 40021 - DNA, 24 bp, Homo sapiens
tttatctcacaggcaatctgaagg

SEQ ID NO: 40022 - DNA, 24 bp, Homo sapiens
ttttatctcacaggcaatctgaag

SEQ ID NO: 40023 - DNA, 24 bp, Homo sapiens
catgccccaggccaggctcagcag

SEQ ID NO: 40024 - DNA, 24 bp, Homo sapiens
tcatgccccaggccaggctcagca

SEQ ID NO: 40025 - DNA, 24 bp, Homo sapiens
atcatgccccaggccaggctcagc

SEQ ID NO: 40026 - DNA, 24 bp, Homo sapiens
gcaggacaaggtgtcattggagga

SEQ ID NO: 40027 - DNA, 24 bp, Homo sapiens
agcaggacaaggtgtcattggagg

SEQ ID NO: 40028 - DNA, 24 bp, Homo sapiens
cagcaggacaaggtgtcattggag

SEQ ID NO: 40029 - DNA, 24 bp, Homo sapiens
agcgacagttcaaggaggagaagc

SEQ ID NO: 40030 - DNA, 24 bp, Homo sapiens
gtagactggcacagcaccttgtcc

SEQ ID NO: 40031 - DNA, 24 bp, Homo sapiens
ctcattgaatcagcatctccaggc

SEQ ID NO: 40032 - DNA, 24 bp, Homo sapiens
ctcattgaatcagcatctccaggc

SEQ ID NO: 40033 - DNA, 24 bp, Homo sapiens
agggagaagttacgggaagggaga

SEQ ID NO: 40034 - DNA, 24 bp, Homo sapiens
agcgacagttcaaggaggagaagc

SEQ ID NO: 40035 - DNA, 24 bp, Homo sapiens
ctcattgaatcagcatctccaggc

SEQ ID NO: 40036 - DNA, 24 bp, Homo sapiens
actccagatgagccagacaagtcc

SEQ ID NO: 40037 - DNA, 24 bp, Homo sapiens
gtagactggcacagcaccttgtcc

SEQ ID NO: 40038 - DNA, 24 bp, Homo sapiens
tctgcccccagtccctggccccac

SEQ ID NO: 40039 - DNA, 24 bp, Homo sapiens
atctgcccccagtccctggcccca

SEQ ID NO: 40040 - DNA, 24 bp, Homo sapiens
catctgcccccagtccctggcccc

SEQ ID NO: 40041 - DNA, 24 bp, Homo sapiens
aagttgaggtggctgagaaagtgc

SEQ ID NO: 40042 - DNA, 24 bp, Homo sapiens
ctcattgaatcagcatctccaggc

SEQ ID NO: 40043 - DNA, 24 bp, Homo sapiens
agcgacagttcaaggaggagaagc

SEQ ID NO: 40044 - DNA, 24 bp, Homo sapiens
tcatcagagaggtaagatggaata

SEQ ID NO: 40045 - DNA, 24 bp, Homo sapiens
ctcatcagagaggtaagatggaat

SEQ ID NO: 40046 - DNA, 24 bp, Homo sapiens
actcatcagagaggtaagatggaa

SEQ ID NO: 40047 - DNA, 24 bp, Homo sapiens
taatagtatagtttaatgacatgt

SEQ ID NO: 40048 - DNA, 24 bp, Homo sapiens
ctaatagtatagtttaatgacatg

SEQ ID NO: 40049 - DNA, 24 bp, Homo sapiens
actaatagtatagtttaatgacat

SEQ ID NO: 40050 - DNA, 24 bp, Homo sapiens
aatgaagaagaaaatcttattgca

SEQ ID NO: 40051 - DNA, 24 bp, Homo sapiens
caatgaagaagaaaatcttattgc

SEQ ID NO: 40052 - DNA, 24 bp, Homo sapiens
gcaatgaagaagaaaatcttattg

SEQ ID NO: 40053 - DNA, 25 bp, Homo sapiens
ttggagaatctggtgatgaagagga

SEQ ID NO: 40054 - DNA, 25 bp, Homo sapiens
acagtgagtcaggcaatgaagaaga

SEQ ID NO: 40055 - DNA, 25 bp, Homo sapiens
agaccatagcatctgacagtgagga

SEQ ID NO: 40056 - DNA, 23 bp, Homo sapiens
atgcctgcccgcccgccagcctg

SEQ ID NO: 40057 - DNA, 25 bp, Homo sapiens
ggtgcttctaggaagtagaacgccg

SEQ ID NO: 40058 - DNA, 23 bp, Homo sapiens
ctctactgcctgccctgccatga

SEQ ID NO: 40059 - DNA, 23 bp, Homo sapiens
ccatcgagggccgagtggtcaac

SEQ ID NO: 40060 - DNA, 23 bp, Homo sapiens
ggcgtccccatctgcggggcctg

SEQ ID NO: 40061 - DNA, 25 bp, Homo sapiens
gcctactgcgagactcactacaacc

SEQ ID NO: 40062 - DNA, 25 bp, Homo sapiens
atgtgattgaaggcgatgtggtgtc

SEQ ID NO: 40063 - DNA, 23 bp, Homo sapiens
gctgcttctcctgctccacctgc

SEQ ID NO: 40064 - DNA, 23 bp, Homo sapiens
ccatcagagggacgaaacaccgc

SEQ ID NO: 40065 - DNA, 24 bp, Homo sapiens
ggcatctggctcctctatgggtca

SEQ ID NO: 40066 - DNA, 23 bp, Homo sapiens
gaggtggcaggtgggcatgtgtg

SEQ ID NO: 40067 - DNA, 24 bp, Homo sapiens
atcttaatcaggtaggagtatttt

SEQ ID NO: 40068 - DNA, 24 bp, Homo sapiens
aatcttaatcaggtaggagtattt

SEQ ID NO: 40069 - DNA, 24 bp, Homo sapiens
taatcttaatcaggtaggagtatt

SEQ ID NO: 40070 - DNA, 24 bp, Homo sapiens
accaagcagtggaccttcaattac

SEQ ID NO: 40071 - DNA, 24 bp, Homo sapiens
taccaagcagtggaccttcaatta

SEQ ID NO: 40072 - DNA, 24 bp, Homo sapiens
ttaccaagcagtggaccttcaatt

SEQ ID NO: 40073 - DNA, 24 bp, Homo sapiens
gagacaggaacacgggcaagacag

SEQ ID NO: 40074 - DNA, 24 bp, Homo sapiens
acaggagatccaggtcaccagcat

SEQ ID NO: 40075 - DNA, 24 bp, Homo sapiens
gctacaagaccacggatgacatcg

SEQ ID NO: 40076 - DNA, 24 bp, Homo sapiens
taattaataaggttccccaatatc

SEQ ID NO: 40077 - DNA, 24 bp, Homo sapiens
ttaattaataaggttccccaatat

SEQ ID NO: 40078 - DNA, 24 bp, Homo sapiens
tttaattaataaggttccccaata

SEQ ID NO: 40079 - DNA, 24 bp, Homo sapiens
ttgaattagatgcaatggatcact

SEQ ID NO: 40080 - DNA, 24 bp, Homo sapiens
tttgaattagatgcaatggatcac

SEQ ID NO: 40081 - DNA, 24 bp, Homo sapiens
ttttgaattagatgcaatggatca

SEQ ID NO: 40082 - DNA, 23 bp, Homo sapiens
ctcctccgtgcggagaagaagct

SEQ ID NO: 40083 - DNA, 23 bp, Homo sapiens
ccgccgtgctggatgctgtgatc

SEQ ID NO: 40084 - DNA, 23 bp, Homo sapiens
agctgtacgcgctggtgtgcgaa

SEQ ID NO: 40085 - DNA, 24 bp, Homo sapiens
atatccgaatgaccaaagaaaagt

SEQ ID NO: 40086 - DNA, 24 bp, Homo sapiens
tatatccgaatgaccaaagaaaag

SEQ ID NO: 40087 - DNA, 24 bp, Homo sapiens
atatatccgaatgaccaaagaaaa

SEQ ID NO: 40088 - DNA, 25 bp, Homo sapiens
tggacatcacaggctcgaaggaatc

SEQ ID NO: 40089 - DNA, 23 bp, Homo sapiens
gtgctggaggaggtggtgctgta

SEQ ID NO: 40090 - DNA, 25 bp, Homo sapiens
gtgcgtctactatgtctccaagtcc

SEQ ID NO: 40091 - DNA, 24 bp, Homo sapiens
tgttcttccaggtaattcttaaaa

SEQ ID NO: 40092 - DNA, 24 bp, Homo sapiens
atgttcttccaggtaattcttaaa

SEQ ID NO: 40093 - DNA, 24 bp, Homo sapiens
tatgttcttccaggtaattcttaa

SEQ ID NO: 40094 - DNA, 23 bp, Homo sapiens
aggtcaaggctccacaaggctca

SEQ ID NO: 40095 - DNA, 23 bp, Homo sapiens
atctcctgacctcgtgatccgcc

SEQ ID NO: 40096 - DNA, 25 bp, Homo sapiens
actaccgagtcaacattcactgatt

SEQ ID NO: 40097 - DNA, 24 bp, Homo sapiens
cctcttcaaagcagaagcaggaca

SEQ ID NO: 40098 - DNA, 24 bp, Homo sapiens
tcctcttcaaagcagaagcaggac

SEQ ID NO: 40099 - DNA, 24 bp, Homo sapiens
ttcctcttcaaagcagaagcagga

SEQ ID NO: 40100 - DNA, 23 bp, Homo sapiens
ccagagccaagaccttctccaga

SEQ ID NO: 40101 - DNA, 23 bp, Homo sapiens
ccaccaccaccaatgtcagccct

SEQ ID NO: 40102 - DNA, 25 bp, Homo sapiens
tcctgccatgaagaatgccactagc

SEQ ID NO: 40103 - DNA, 23 bp, Homo sapiens
ccagagccaagaccttctccaga

SEQ ID NO: 40104 - DNA, 25 bp, Homo sapiens
tcctgccatgaagaatgccactagc

SEQ ID NO: 40105 - DNA, 23 bp, Homo sapiens
cagccagccatctccaacagcag

SEQ ID NO: 40106 - DNA, 24 bp, Homo sapiens
tcagtaaaaaggtaaattaaaatg

SEQ ID NO: 40107 - DNA, 24 bp, Homo sapiens
ctcagtaaaaaggtaaattaaaat

SEQ ID NO: 40108 - DNA, 24 bp, Homo sapiens
gctcagtaaaaaggtaaattaaaa

SEQ ID NO: 40109 - DNA, 24 bp, Homo sapiens
cttcaggtgatgtggctggcagat

SEQ ID NO: 40110 - DNA, 25 bp, Homo sapiens
tctctctttgaggaatgctctcggt

SEQ ID NO: 40111 - DNA, 25 bp, Homo sapiens
gctgcttcttccgatccatgttcac

SEQ ID NO: 40112 - DNA, 24 bp, Homo sapiens
ataaactaaaggtaagttgctgag

SEQ ID NO: 40113 - DNA, 24 bp, Homo sapiens
gataaactaaaggtaagttgctga

SEQ ID NO: 40114 - DNA, 24 bp, Homo sapiens
ggataaactaaaggtaagttgctg

SEQ ID NO: 40115 - DNA, 23 bp, Homo sapiens
gtgacgcgggcatgagcctgctc

SEQ ID NO: 40116 - DNA, 23 bp, Homo sapiens
gccgctgagcaggcgctcctggc

SEQ ID NO: 40117 - DNA, 23 bp, Homo sapiens
cgccgccctgccgcccccgccag

SEQ ID NO: 40118 - DNA, 23 bp, Homo sapiens
ccgtgtgaagctcgtctcgtggc

SEQ ID NO: 40119 - DNA, 24 bp, Homo sapiens
gaacatctacctctgggacatcca

SEQ ID NO: 40120 - DNA, 23 bp, Homo sapiens
tgctgccctgccccaacctggac

SEQ ID NO: 40121 - DNA, 24 bp, Homo sapiens
gttcaccacagtttcatcctacaa

SEQ ID NO: 40122 - DNA, 24 bp, Homo sapiens
agttcaccacagtttcatcctaca

SEQ ID NO: 40123 - DNA, 24 bp, Homo sapiens
gagttcaccacagtttcatcctac

SEQ ID NO: 40124 - DNA, 24 bp, Homo sapiens
atttctcatgtgtaagtttttcac

SEQ ID NO: 40125 - DNA, 24 bp, Homo sapiens
catttctcatgtgtaagtttttca

SEQ ID NO: 40126 - DNA, 24 bp, Homo sapiens
acatttctcatgtgtaagtttttc

SEQ ID NO: 40127 - DNA, 24 bp, Homo sapiens
agcagatcacggtgcggttctccc

SEQ ID NO: 40128 - DNA, 24 bp, Homo sapiens
aagcagatcacggtgcggttctcc

SEQ ID NO: 40129 - DNA, 24 bp, Homo sapiens
taagcagatcacggtgcggttctc

SEQ ID NO: 40130 - DNA, 23 bp, Homo sapiens
atgtggaagttcacgcagagccg

SEQ ID NO: 40131 - DNA, 24 bp, Homo sapiens
ctgggtggtgaagagtgacatcct

SEQ ID NO: 40132 - DNA, 23 bp, Homo sapiens
ccagaaggtggcgatgttggtcc

SEQ ID NO: 40133 - DNA, 23 bp, Homo sapiens
cacactcttcagcggcatctcgg

SEQ ID NO: 40134 - DNA, 23 bp, Homo sapiens
cgaggaggacgaggagcaggagg

SEQ ID NO: 40135 - DNA, 23 bp, Homo sapiens
ggtgtgcggatcaaggaggagcc

SEQ ID NO: 40136 - DNA, 23 bp, Homo sapiens
gaggcaggtggatcacgaggtca

SEQ ID NO: 40137 - DNA, 23 bp, Homo sapiens
tgataaagaagttggcctggtgt

SEQ ID NO: 40138 - DNA, 24 bp, Homo sapiens
ggacagactattacaagataaagc

SEQ ID NO: 40139 - DNA, 24 bp, Homo sapiens
tcttctcagcctgtgtcacgacca

SEQ ID NO: 40140 - DNA, 23 bp, Homo sapiens
acaaccagcaccgcctcttcaac

SEQ ID NO: 40141 - DNA, 25 bp, Homo sapiens
ggaccatctcagaccaccatacact

SEQ ID NO: 40142 - DNA, 25 bp, Homo sapiens
ctggcagtgattcaagtggtgtcat

SEQ ID NO: 40143 - DNA, 24 bp, Homo sapiens
tcttctcagcctgtgtcacgacca

SEQ ID NO: 40144 - DNA, 23 bp, Homo sapiens
acaaccagcaccgcctcttcaac

SEQ ID NO: 40145 - DNA, 24 bp, Homo sapiens
atgttagaaaggttataccaaaag

SEQ ID NO: 40146 - DNA, 24 bp, Homo sapiens
tatgttagaaaggttataccaaaa

SEQ ID NO: 40147 - DNA, 24 bp, Homo sapiens
ctatgttagaaaggttataccaaa

SEQ ID NO: 40148 - DNA, 25 bp, Homo sapiens
agactgtgattcagcaaggtgatga

SEQ ID NO: 40149 - DNA, 23 bp, Homo sapiens
gaacaccgagagcagccactgtc

SEQ ID NO: 40150 - DNA, 25 bp, Homo sapiens
ggcatcgaccgagacagctatagaa

SEQ ID NO: 40151 - DNA, 24 bp, Homo sapiens
gggatgtggaggtattttgatgtt

SEQ ID NO: 40152 - DNA, 24 bp, Homo sapiens
cgggatgtggaggtattttgatgt

SEQ ID NO: 40153 - DNA, 24 bp, Homo sapiens
ccgggatgtggaggtattttgatg

SEQ ID NO: 40154 - DNA, 23 bp, Homo sapiens
gcagtggctggtgtggcttctcc

SEQ ID NO: 40155 - DNA, 23 bp, Homo sapiens
atgcgaccgactttgagtggagc

SEQ ID NO: 40156 - DNA, 23 bp, Homo sapiens
acatggtagtgtctcaaatggcc

SEQ ID NO: 40157 - DNA, 24 bp, Homo sapiens
aattcacacgggagacaaacccca

SEQ ID NO: 40158 - DNA, 24 bp, Homo sapiens
aaattcacacgggagacaaacccc

SEQ ID NO: 40159 - DNA, 24 bp, Homo sapiens
aaaattcacacgggagacaaaccc

SEQ ID NO: 40160 - DNA, 25 bp, Homo sapiens
gactcaagcaatcctcctcctcctg

SEQ ID NO: 40161 - DNA, 25 bp, Homo sapiens
ttgccacatccaggtcagtagaaca

SEQ ID NO: 40162 - DNA, 25 bp, Homo sapiens
tgattctcctgccttagccttctga

SEQ ID NO: 40163 - DNA, 25 bp, Homo sapiens
ccacacggcttcagaacttgatgat

SEQ ID NO: 40164 - DNA, 23 bp, Homo sapiens
cctacgccagccgcaactccagc

SEQ ID NO: 40165 - DNA, 23 bp, Homo sapiens
gacagcagcagcctcaacaagca

SEQ ID NO: 40166 - DNA, 25 bp, Homo sapiens
ttcaagcaattctgcctcagcctcc

SEQ ID NO: 40167 - DNA, 23 bp, Homo sapiens
gccgtttgggaacagcatggagc

SEQ ID NO: 40168 - DNA, 23 bp, Homo sapiens
cggtctaacgcccactgtggacg

SEQ ID NO: 40169 - DNA, 24 bp, Homo sapiens
tggcgtccaagggagtcggtagta

SEQ ID NO: 40170 - DNA, 24 bp, Homo sapiens
ttggcgtccaagggagtcggtagt

SEQ ID NO: 40171 - DNA, 24 bp, Homo sapiens
gttggcgtccaagggagtcggtag

SEQ ID NO: 40172 - DNA, 25 bp, Homo sapiens
gccacagttatcagaacagcggtct

SEQ ID NO: 40173 - DNA, 25 bp, Homo sapiens
ctgggagacctttggaagtgctgag

SEQ ID NO: 40174 - DNA, 23 bp, Homo sapiens
aacaggaacagcaacagcgacgg

SEQ ID NO: 40175 - DNA, 23 bp, Homo sapiens
gcaaccaccaagccttccagaag

SEQ ID NO: 40176 - DNA, 23 bp, Homo sapiens
cgctccaccaccacctccgacat

SEQ ID NO: 40177 - DNA, 23 bp, Homo sapiens
gccgccttcagcaagctctttga

SEQ ID NO: 40178 - DNA, 24 bp, Homo sapiens
tcattacacaggacattttagatg

SEQ ID NO: 40179 - DNA, 24 bp, Homo sapiens
ttcattacacaggacattttagat

SEQ ID NO: 40180 - DNA, 24 bp, Homo sapiens
attcattacacaggacattttaga

SEQ ID NO: 40181 - DNA, 24 bp, Homo sapiens
ggtaacacagaggctctttccggg

SEQ ID NO: 40182 - DNA, 24 bp, Homo sapiens
tggtaacacagaggctctttccgg

SEQ ID NO: 40183 - DNA, 24 bp, Homo sapiens
ctggtaacacagaggctctttccg

SEQ ID NO: 40184 - DNA, 24 bp, Homo sapiens
aactgatgaagagaaactggagag

SEQ ID NO: 40185 - DNA, 24 bp, Homo sapiens
gaactgatgaagagaaactggaga

SEQ ID NO: 40186 - DNA, 24 bp, Homo sapiens
agaactgatgaagagaaactggag

SEQ ID NO: 40187 - DNA, 24 bp, Homo sapiens
cccgttttgtgaatctgtaatgaa

SEQ ID NO: 40188 - DNA, 24 bp, Homo sapiens
ccccgttttgtgaatctgtaatga

SEQ ID NO: 40189 - DNA, 24 bp, Homo sapiens
gccccgttttgtgaatctgtaatg

SEQ ID NO: 40190 - DNA, 25 bp, Homo sapiens
gctcatgcctgtaatcccagcagtt

SEQ ID NO: 40191 - DNA, 24 bp, Homo sapiens
agaatgctgatattcaggccaggc

SEQ ID NO: 40192 - DNA, 25 bp, Homo sapiens
agaatcctttgagatggtgccttgc

SEQ ID NO: 40193 - DNA, 23 bp, Homo sapiens
agtgatcctcccaccttggcctc

SEQ ID NO: 40194 - DNA, 23 bp, Homo sapiens
gcccaggctggtctaaaactcct

SEQ ID NO: 40195 - DNA, 23 bp, Homo sapiens
gttgctcacagaggtgcctgctt

SEQ ID NO: 40196 - DNA, 24 bp, Homo sapiens
gcctggaagaactcgtcatgctct

SEQ ID NO: 40197 - DNA, 25 bp, Homo sapiens
tgccatgattggaagtttcctgagg

SEQ ID NO: 40198 - DNA, 23 bp, Homo sapiens
gttgctcacagaggtgcctgctt

SEQ ID NO: 40199 - DNA, 24 bp, Homo sapiens
caagcctggaagaactcgtcatgc

SEQ ID NO: 40200 - DNA, 25 bp, Homo sapiens
tgccatgattggaagtttcctgagg

SEQ ID NO: 40201 - DNA, 24 bp, Homo sapiens
gttatttgtagaatttttcagact

SEQ ID NO: 40202 - DNA, 24 bp, Homo sapiens
tgttatttgtagaatttttcagac

SEQ ID NO: 40203 - DNA, 24 bp, Homo sapiens
ctgttatttgtagaatttttcaga

SEQ ID NO: 40204 - DNA, 24 bp, Homo sapiens
aaaaattgaagaaatggctgagca

SEQ ID NO: 40205 - DNA, 24 bp, Homo sapiens
aaaaaattgaagaaatggctgagc

SEQ ID NO: 40206 - DNA, 24 bp, Homo sapiens
gaaaaaattgaagaaatggctgag

SEQ ID NO: 40207 - DNA, 24 bp, Homo sapiens
aaaaattgaaggtgaaagaatttg

SEQ ID NO: 40208 - DNA, 24 bp, Homo sapiens
aaaaaattgaaggtgaaagaattt

SEQ ID NO: 40209 - DNA, 24 bp, Homo sapiens
gaaaaaattgaaggtgaaagaatt

SEQ ID NO: 40210 - DNA, 24 bp, Homo sapiens
aagatgaagaggtaaacattgtta

SEQ ID NO: 40211 - DNA, 24 bp, Homo sapiens
gaagatgaagaggtaaacattgtt

SEQ ID NO: 40212 - DNA, 24 bp, Homo sapiens
tgaagatgaagaggtaaacattgt

SEQ ID NO: 40213 - DNA, 24 bp, Homo sapiens
aagtaggaaaggtaagcaaaaagc

SEQ ID NO: 40214 - DNA, 24 bp, Homo sapiens
gaagtaggaaaggtaagcaaaaag

SEQ ID NO: 40215 - DNA, 24 bp, Homo sapiens
agaagtaggaaaggtaagcaaaaa

SEQ ID NO: 40216 - DNA, 24 bp, Homo sapiens
actcctgacctcaagtgatccgcc

SEQ ID NO: 40217 - DNA, 24 bp, Homo sapiens
tgatccttgaaccaaagagacggg

SEQ ID NO: 40218 - DNA, 24 bp, Homo sapiens
tcagactccgaggaagatgatgct

SEQ ID NO: 40219 - DNA, 24 bp, Homo sapiens
tctcaagtcggaccaagaccagca

SEQ ID NO: 40220 - DNA, 24 bp, Homo sapiens
gactcctttgtgccctcagacttg

SEQ ID NO: 40221 - DNA, 23 bp, Homo sapiens
gctgccgacaaccaccttcattg

SEQ ID NO: 40222 - DNA, 23 bp, Homo sapiens
ggttctcgccctgcccttcaaac

SEQ ID NO: 40223 - DNA, 23 bp, Homo sapiens
cgtggtgtgtcctgagcagtaca

SEQ ID NO: 40224 - DNA, 25 bp, Homo sapiens
cggctgaacttcatccaggtgtcaa

SEQ ID NO: 40225 - DNA, 24 bp, Homo sapiens
tttattccaagtttcacagtaagc

SEQ ID NO: 40226 - DNA, 24 bp, Homo sapiens
ttttattccaagtttcacagtaag

SEQ ID NO: 40227 - DNA, 24 bp, Homo sapiens
tttttattccaagtttcacagtaa

SEQ ID NO: 40228 - DNA, 25 bp, Homo sapiens
ctttctcttctttgtggatcagaat

SEQ ID NO: 40229 - DNA, 25 bp, Homo sapiens
cattcattatgagccattcttattg

SEQ ID NO: 40230 - DNA, 23 bp, Homo sapiens
atattcagttctccttcatgtgt

SEQ ID NO: 40231 - DNA, 23 bp, Homo sapiens
gtggtgcggctgctactaggctc

SEQ ID NO: 40232 - DNA, 23 bp, Homo sapiens
tccaagtcggtgactgcccactt

SEQ ID NO: 40233 - DNA, 23 bp, Homo sapiens
ctgtggctttcgcagctcggctc

SEQ ID NO: 40234 - DNA, 24 bp, Homo sapiens
taaaacgtcagtcaaatcagaaaa

SEQ ID NO: 40235 - DNA, 24 bp, Homo sapiens
ctaaaacgtcagtcaaatcagaaa

SEQ ID NO: 40236 - DNA, 24 bp, Homo sapiens
tctaaaacgtcagtcaaatcagaa

SEQ ID NO: 40237 - DNA, 24 bp, Homo sapiens
gatacaagaaggtaaattctattt

SEQ ID NO: 40238 - DNA, 24 bp, Homo sapiens
ggatacaagaaggtaaattctatt

SEQ ID NO: 40239 - DNA, 24 bp, Homo sapiens
gggatacaagaaggtaaattctat

SEQ ID NO: 40240 - DNA, 24 bp, Homo sapiens
tttccttgaagcatttctttgaag

SEQ ID NO: 40241 - DNA, 24 bp, Homo sapiens
atttccttgaagcatttctttgaa

SEQ ID NO: 40242 - DNA, 24 bp, Homo sapiens
catttccttgaagcatttctttga

SEQ ID NO: 40243 - DNA, 24 bp, Homo sapiens
atatattctagaaccacatggact

SEQ ID NO: 40244 - DNA, 24 bp, Homo sapiens
catatattctagaaccacatggac

SEQ ID NO: 40245 - DNA, 24 bp, Homo sapiens
gcatatattctagaaccacatgga

SEQ ID NO: 40246 - DNA, 24 bp, Homo sapiens
tgggttgacatgttgatcgacatc

SEQ ID NO: 40247 - DNA, 24 bp, Homo sapiens
ctgggttgacatgttgatcgacat

SEQ ID NO: 40248 - DNA, 24 bp, Homo sapiens
gctgggttgacatgttgatcgaca

SEQ ID NO: 40249 - DNA, 24 bp, Homo sapiens
cacccctgcggaaatccaccatgg

SEQ ID NO: 40250 - DNA, 24 bp, Homo sapiens
tcacccctgcggaaatccaccatg

SEQ ID NO: 40251 - DNA, 24 bp, Homo sapiens
ctcacccctgcggaaatccaccat

SEQ ID NO: 40252 - DNA, 24 bp, Homo sapiens
attggataaagatataataaccct

SEQ ID NO: 40253 - DNA, 24 bp, Homo sapiens
aattggataaagatataataaccc

SEQ ID NO: 40254 - DNA, 24 bp, Homo sapiens
aaattggataaagatataataacc

SEQ ID NO: 40255 - DNA, 24 bp, Homo sapiens
tgttctgaacagagcaagtaatac

SEQ ID NO: 40256 - DNA, 24 bp, Homo sapiens
atgttctgaacagagcaagtaata

SEQ ID NO: 40257 - DNA, 24 bp, Homo sapiens
aatgttctgaacagagcaagtaat

SEQ ID NO: 40258 - DNA, 23 bp, Homo sapiens
cctcccgcctcacccttcagagt

SEQ ID NO: 40259 - DNA, 23 bp, Homo sapiens
tcctgtccttctgcggcagtctt

SEQ ID NO: 40260 - DNA, 23 bp, Homo sapiens
gcagcctcaagctcctgtgctca

SEQ ID NO: 40261 - DNA, 24 bp, Homo sapiens
ctaagattaagcttggaagtcttt

SEQ ID NO: 40262 - DNA, 24 bp, Homo sapiens
actaagattaagcttggaagtctt

SEQ ID NO: 40263 - DNA, 24 bp, Homo sapiens
cactaagattaagcttggaagtct

SEQ ID NO: 40264 - DNA, 24 bp, Homo sapiens
gacttaagaaggtaacagaacttt

SEQ ID NO: 40265 - DNA, 24 bp, Homo sapiens
agacttaagaaggtaacagaactt

SEQ ID NO: 40266 - DNA, 24 bp, Homo sapiens
tagacttaagaaggtaacagaact

SEQ ID NO: 40267 - DNA, 24 bp, Homo sapiens
atttcttcaaggtgagaatgcagg

SEQ ID NO: 40268 - DNA, 24 bp, Homo sapiens
tatttcttcaaggtgagaatgcag

SEQ ID NO: 40269 - DNA, 24 bp, Homo sapiens
ctatttcttcaaggtgagaatgca

SEQ ID NO: 40270 - DNA, 24 bp, Homo sapiens
ttgttatttagaaagccaaacttg

SEQ ID NO: 40271 - DNA, 24 bp, Homo sapiens
cttgttatttagaaagccaaactt

SEQ ID NO: 40272 - DNA, 24 bp, Homo sapiens
gcttgttatttagaaagccaaact

SEQ ID NO: 40273 - DNA, 24 bp, Homo sapiens
gttttccagagttatttcctgaaa

SEQ ID NO: 40274 - DNA, 24 bp, Homo sapiens
agttttccagagttatttcctgaa

SEQ ID NO: 40275 - DNA, 24 bp, Homo sapiens
aagttttccagagttatttcctga

SEQ ID NO: 40276 - DNA, 23 bp, Homo sapiens
aagcgaagatggcgacttctggc

SEQ ID NO: 40277 - DNA, 23 bp, Homo sapiens
agctggtgatcggctggtgcata

SEQ ID NO: 40278 - DNA, 23 bp, Homo sapiens
ctccgcccctttaacctttaggg

SEQ ID NO: 40279 - DNA, 24 bp, Homo sapiens
tgtggtggcagctgtaggcattca

SEQ ID NO: 40280 - DNA, 24 bp, Homo sapiens
ctgtggtggcagctgtaggcattc

SEQ ID NO: 40281 - DNA, 24 bp, Homo sapiens
cctgtggtggcagctgtaggcatt

SEQ ID NO: 40282 - DNA, 23 bp, Homo sapiens
tcggctcactgcaacctctacct

SEQ ID NO: 40283 - DNA, 24 bp, Homo sapiens
tatctactgggatttacgagtatc

SEQ ID NO: 40284 - DNA, 24 bp, Homo sapiens
ttatctactgggatttacgagtat

SEQ ID NO: 40285 - DNA, 24 bp, Homo sapiens
cttatctactgggatttacgagta

SEQ ID NO: 40286 - DNA, 24 bp, Homo sapiens
gggaccaagaacctctgtgtggag

SEQ ID NO: 40287 - DNA, 23 bp, Homo sapiens
atgccgacacaccactgcctgcc

SEQ ID NO: 40288 - DNA, 23 bp, Homo sapiens
cgcatccgccgctttctccagat

SEQ ID NO: 40289 - DNA, 24 bp, Homo sapiens
ttattttctagctgaagaaaagct

SEQ ID NO: 40290 - DNA, 24 bp, Homo sapiens
tttattttctagctgaagaaaagc

SEQ ID NO: 40291 - DNA, 24 bp, Homo sapiens
gtttattttctagctgaagaaaag

SEQ ID NO: 40292 - DNA, 24 bp, Homo sapiens
aatagtggagaaagtgttgatttt

SEQ ID NO: 40293 - DNA, 24 bp, Homo sapiens
caatagtggagaaagtgttgattt

SEQ ID NO: 40294 - DNA, 24 bp, Homo sapiens
gcaatagtggagaaagtgttgatt

SEQ ID NO: 40295 - DNA, 23 bp, Homo sapiens
gcggcggctgcaagaggactaag

SEQ ID NO: 40296 - DNA, 23 bp, Homo sapiens
aaggaccgaaggggatacagcgt

SEQ ID NO: 40297 - DNA, 23 bp, Homo sapiens
tcctccactgccggggctgggcc

SEQ ID NO: 40298 - DNA, 24 bp, Homo sapiens
cataattaaaggtgcagaatttca

SEQ ID NO: 40299 - DNA, 24 bp, Homo sapiens
gcataattaaaggtgcagaatttc

SEQ ID NO: 40300 - DNA, 24 bp, Homo sapiens
agcataattaaaggtgcagaattt

SEQ ID NO: 40301 - DNA, 24 bp, Homo sapiens
gttatcataagatcttgaggctga

SEQ ID NO: 40302 - DNA, 24 bp, Homo sapiens
tgttatcataagatcttgaggctg

SEQ ID NO: 40303 - DNA, 24 bp, Homo sapiens
gtgttatcataagatcttgaggct

SEQ ID NO: 40304 - DNA, 24 bp, Homo sapiens
ttgccaacagggtgctgcttacaa

SEQ ID NO: 40305 - DNA, 24 bp, Homo sapiens
attgccaacagggtgctgcttaca

SEQ ID NO: 40306 - DNA, 24 bp, Homo sapiens
aattgccaacagggtgctgcttac

SEQ ID NO: 40307 - DNA, 24 bp, Homo sapiens
tcttcatttagccagtgatggtgt

SEQ ID NO: 40308 - DNA, 24 bp, Homo sapiens
ctcttcatttagccagtgatggtg

SEQ ID NO: 40309 - DNA, 24 bp, Homo sapiens
tctcttcatttagccagtgatggt

SEQ ID NO: 40310 - DNA, 24 bp, Homo sapiens
ttcttaaaaaggttcataacttat

SEQ ID NO: 40311 - DNA, 24 bp, Homo sapiens
tttcttaaaaaggttcataactta

SEQ ID NO: 40312 - DNA, 24 bp, Homo sapiens
atttcttaaaaaggttcataactt

SEQ ID NO: 40313 - DNA, 24 bp, Homo sapiens
gtctcccacagtgtggccgcagcg

SEQ ID NO: 40314 - DNA, 24 bp, Homo sapiens
cgtctcccacagtgtggccgcagc

SEQ ID NO: 40315 - DNA, 24 bp, Homo sapiens
acgtctcccacagtgtggccgcag

SEQ ID NO: 40316 - DNA, 24 bp, Homo sapiens
atattttgaagttgtctcccaacc

SEQ ID NO: 40317 - DNA, 24 bp, Homo sapiens
aatattttgaagttgtctcccaac

SEQ ID NO: 40318 - DNA, 24 bp, Homo sapiens
aaatattttgaagttgtctcccaa

SEQ ID NO: 40319 - DNA, 24 bp, Homo sapiens
ccattagctgtggagttatttatt

SEQ ID NO: 40320 - DNA, 24 bp, Homo sapiens
tccattagctgtggagttatttat

SEQ ID NO: 40321 - DNA, 24 bp, Homo sapiens
ttccattagctgtggagttattta

SEQ ID NO: 40322 - DNA, 23 bp, Homo sapiens
cgctgctgccaccgccatctaac

SEQ ID NO: 40323 - DNA, 25 bp, Homo sapiens
ctaagaaggagagtatgaggcgagc

SEQ ID NO: 40324 - DNA, 23 bp, Homo sapiens
cgggtgcggccgggcttcagggg

SEQ ID NO: 40325 - DNA, 23 bp, Homo sapiens
ctgcggctgctgtggaacctgat

SEQ ID NO: 40326 - DNA, 24 bp, Homo sapiens
tctctacgtggtctttcagaagct

SEQ ID NO: 40327 - DNA, 25 bp, Homo sapiens
cctatggctggtacatcgtcttcag

SEQ ID NO: 40328 - DNA, 24 bp, Homo sapiens
ctcaatgtagagtaagtatgtaac

SEQ ID NO: 40329 - DNA, 24 bp, Homo sapiens
actcaatgtagagtaagtatgtaa

SEQ ID NO: 40330 - DNA, 24 bp, Homo sapiens
aactcaatgtagagtaagtatgta

SEQ ID NO: 40331 - DNA, 23 bp, Homo sapiens
ctgcgggctggctgggcgtagtg

SEQ ID NO: 40332 - DNA, 23 bp, Homo sapiens
ctgcttggcgcgacgctctagcg

SEQ ID NO: 40333 - DNA, 24 bp, Homo sapiens
tcctgacctcttgatccacctgcc

SEQ ID NO: 40334 - DNA, 23 bp, Homo sapiens
ttcactgacacgttgtacttcat

SEQ ID NO: 40335 - DNA, 24 bp, Homo sapiens
ccacggcgccctgatgtatatgag

SEQ ID NO: 40336 - DNA, 24 bp, Homo sapiens
aagttaagcaggtatgtttctggc

SEQ ID NO: 40337 - DNA, 24 bp, Homo sapiens
aaagttaagcaggtatgtttctgg

SEQ ID NO: 40338 - DNA, 24 bp, Homo sapiens
taaagttaagcaggtatgtttctg

SEQ ID NO: 40339 - DNA, 23 bp, Homo sapiens
cctgctgcacaaccagtacctcg

SEQ ID NO: 40340 - DNA, 23 bp, Homo sapiens
acggctgccagtggactactatg

SEQ ID NO: 40341 - DNA, 23 bp, Homo sapiens
cagccacagcagagccaatcaca

SEQ ID NO: 40342 - DNA, 24 bp, Homo sapiens
gaaaaactcaggaaagaaattgca

SEQ ID NO: 40343 - DNA, 24 bp, Homo sapiens
ggaaaaactcaggaaagaaattgc

SEQ ID NO: 40344 - DNA, 24 bp, Homo sapiens
tggaaaaactcaggaaagaaattg

SEQ ID NO: 40345 - DNA, 23 bp, Homo sapiens
ggattacagccgtgagccactgc

SEQ ID NO: 40346 - DNA, 24 bp, Homo sapiens
aggctggtctcaaactcccgactt

SEQ ID NO: 40347 - DNA, 25 bp, Homo sapiens
taaggcaaacttgtctgttctctag

SEQ ID NO: 40348 - DNA, 24 bp, Homo sapiens
tcactgaacctatggttgaaaaag

SEQ ID NO: 40349 - DNA, 24 bp, Homo sapiens
gtcactgaacctatggttgaaaaa

SEQ ID NO: 40350 - DNA, 24 bp, Homo sapiens
ggtcactgaacctatggttgaaaa

SEQ ID NO: 40351 - DNA, 24 bp, Homo sapiens
attctaaatgtgtatattgcaaac

SEQ ID NO: 40352 - DNA, 24 bp, Homo sapiens
gattctaaatgtgtatattgcaaa

SEQ ID NO: 40353 - DNA, 24 bp, Homo sapiens
ggattctaaatgtgtatattgcaa

SEQ ID NO: 40354 - DNA, 24 bp, Homo sapiens
ctgattgctctggctaggacttcc

SEQ ID NO: 40355 - DNA, 25 bp, Homo sapiens
acattgaatagcagtgtaattggga

SEQ ID NO: 40356 - DNA, 25 bp, Homo sapiens
gttgaaaatgaatgtacacatagtt

SEQ ID NO: 40357 - DNA, 23 bp, Homo sapiens
gtgccccagccgaagccggagtc

SEQ ID NO: 40358 - DNA, 23 bp, Homo sapiens
gcgggcggcagggcagcaggacc

SEQ ID NO: 40359 - DNA, 23 bp, Homo sapiens
gggcgccggcatagtacaatgag

SEQ ID NO: 40360 - DNA, 24 bp, Homo sapiens
acttgaaaaaggtaatttttttaa

SEQ ID NO: 40361 - DNA, 24 bp, Homo sapiens
aacttgaaaaaggtaattttttta

SEQ ID NO: 40362 - DNA, 24 bp, Homo sapiens
gaacttgaaaaaggtaattttttt

SEQ ID NO: 40363 - DNA, 23 bp, Homo sapiens
gccgcagcttgtcttccccattt

SEQ ID NO: 40364 - DNA, 23 bp, Homo sapiens
aactagactgctgaatactgaag

SEQ ID NO: 40365 - DNA, 23 bp, Homo sapiens
gtttctcatcaagaaaactgcat

SEQ ID NO: 40366 - DNA, 24 bp, Homo sapiens
atgcagaaatgcaactttgtaagt

SEQ ID NO: 40367 - DNA, 24 bp, Homo sapiens
aatgcagaaatgcaactttgtaag

SEQ ID NO: 40368 - DNA, 24 bp, Homo sapiens
aaatgcagaaatgcaactttgtaa

SEQ ID NO: 40369 - DNA, 24 bp, Homo sapiens
aaagaaatctggtaagatagcaga

SEQ ID NO: 40370 - DNA, 24 bp, Homo sapiens
aaaagaaatctggtaagatagcag

SEQ ID NO: 40371 - DNA, 24 bp, Homo sapiens
aaaaagaaatctggtaagatagca

SEQ ID NO: 40372 - DNA, 24 bp, Homo sapiens
gaataaacacggtaaacagattca

SEQ ID NO: 40373 - DNA, 24 bp, Homo sapiens
tgaataaacacggtaaacagattc

SEQ ID NO: 40374 - DNA, 24 bp, Homo sapiens
ctgaataaacacggtaaacagatt

SEQ ID NO: 40375 - DNA, 25 bp, Homo sapiens
tggcgtcactacaaaggttagagca

SEQ ID NO: 40376 - DNA, 25 bp, Homo sapiens
acagctctgtcaatggactgaatgc

SEQ ID NO: 40377 - DNA, 23 bp, Homo sapiens
ccagccagacaccaagccgaaag

SEQ ID NO: 40378 - DNA, 23 bp, Homo sapiens
gcctgaagtgtgcctgctgtgac

SEQ ID NO: 40379 - DNA, 25 bp, Homo sapiens
gctctttggtgtaacgggaaactgc

SEQ ID NO: 40380 - DNA, 23 bp, Homo sapiens
ccagccagacaccaagccgaaag

SEQ ID NO: 40381 - DNA, 25 bp, Homo sapiens
ctggctgcaaccgaaagatcaagga

SEQ ID NO: 40382 - DNA, 25 bp, Homo sapiens
aaaggcactggacaaatactggcat

SEQ ID NO: 40383 - DNA, 23 bp, Homo sapiens
gtgaggaggctgtggctgtggtg

SEQ ID NO: 40384 - DNA, 25 bp, Homo sapiens
ccagagacacctcagtggatcagag

SEQ ID NO: 40385 - DNA, 23 bp, Homo sapiens
gtggtgggattacaggcgtgagc

SEQ ID NO: 40386 - DNA, 25 bp, Homo sapiens
cagtagtcttgtgctcttcaggaga

SEQ ID NO: 40387 - DNA, 25 bp, Homo sapiens
acccagcctattctttttaagtttc

SEQ ID NO: 40388 - DNA, 24 bp, Homo sapiens
accagccttgggtgagtggcttgg

SEQ ID NO: 40389 - DNA, 24 bp, Homo sapiens
caccagccttgggtgagtggcttg

SEQ ID NO: 40390 - DNA, 24 bp, Homo sapiens
ccaccagccttgggtgagtggctt

SEQ ID NO: 40391 - DNA, 23 bp, Homo sapiens
gccaggagcagcccaaggaagtc

SEQ ID NO: 40392 - DNA, 23 bp, Homo sapiens
acaggactggtggagcagcacag

SEQ ID NO: 40393 - DNA, 23 bp, Homo sapiens
tggaggaggtgtggctggcagag

SEQ ID NO: 40394 - DNA, 23 bp, Homo sapiens
caggagaggagaggcagcagcat

SEQ ID NO: 40395 - DNA, 24 bp, Homo sapiens
agcctttcaccacctctgatgaca

SEQ ID NO: 40396 - DNA, 23 bp, Homo sapiens
gccaggagcagcccaaggaagtc

SEQ ID NO: 40397 - DNA, 23 bp, Homo sapiens
ccatccagacggtgtcctgcctc

SEQ ID NO: 40398 - DNA, 23 bp, Homo sapiens
ctctgagcaggaggaggagcagc

SEQ ID NO: 40399 - DNA, 24 bp, Homo sapiens
caatggtgtctcgctgctgaagga

SEQ ID NO: 40400 - DNA, 25 bp, Homo sapiens
ggacatcttcatcaccagcgtggac

SEQ ID NO: 40401 - DNA, 23 bp, Homo sapiens
accagcagcacccgctcaccctc

SEQ ID NO: 40402 - DNA, 25 bp, Homo sapiens
gctctgtgaggaagtgagagacatg

SEQ ID NO: 40403 - DNA, 24 bp, Homo sapiens
tgaggactccggacactgcccatc

SEQ ID NO: 40404 - DNA, 24 bp, Homo sapiens
ctgaggactccggacactgcccat

SEQ ID NO: 40405 - DNA, 24 bp, Homo sapiens
gctgaggactccggacactgccca

SEQ ID NO: 40406 - DNA, 25 bp, Homo sapiens
ccacaactacgaatgaatgtccatc

SEQ ID NO: 40407 - DNA, 24 bp, Homo sapiens
tacttctcaaaatacttgtaaaag

SEQ ID NO: 40408 - DNA, 23 bp, Homo sapiens
gtgcctgctctgtgcctgctctg

SEQ ID NO: 40409 - DNA, 23 bp, Homo sapiens
ccacggagggacggctgacaaag

SEQ ID NO: 40410 - DNA, 25 bp, Homo sapiens
tgttggagactcagatggaggagga

SEQ ID NO: 40411 - DNA, 24 bp, Homo sapiens
aaattttacaggtattcaattcct

SEQ ID NO: 40412 - DNA, 24 bp, Homo sapiens
aaaattttacaggtattcaattcc

SEQ ID NO: 40413 - DNA, 24 bp, Homo sapiens
aaaaattttacaggtattcaattc

SEQ ID NO: 40414 - DNA, 24 bp, Homo sapiens
tttgtggcaaggattaaaagtaag

SEQ ID NO: 40415 - DNA, 24 bp, Homo sapiens
gtttgtggcaaggattaaaagtaa

SEQ ID NO: 40416 - DNA, 24 bp, Homo sapiens
agtttgtggcaaggattaaaagta

SEQ ID NO: 40417 - DNA, 24 bp, Homo sapiens
ctaatgtataagtaagtttggttt

SEQ ID NO: 40418 - DNA, 24 bp, Homo sapiens
gctaatgtataagtaagtttggtt

SEQ ID NO: 40419 - DNA, 24 bp, Homo sapiens
tgctaatgtataagtaagtttggt

SEQ ID NO: 40420 - DNA, 24 bp, Homo sapiens
tctataggagggttaatatcagta

SEQ ID NO: 40421 - DNA, 24 bp, Homo sapiens
ctctataggagggttaatatcagt

SEQ ID NO: 40422 - DNA, 24 bp, Homo sapiens
actctataggagggttaatatcag

SEQ ID NO: 40423 - DNA, 24 bp, Homo sapiens
actggtttggagagaaagccttgc

SEQ ID NO: 40424 - DNA, 24 bp, Homo sapiens
gaatatattatcaggcaaggtgca

SEQ ID NO: 40425 - DNA, 24 bp, Homo sapiens
gacaccttctttatcatcagcaaa

SEQ ID NO: 40426 - DNA, 24 bp, Homo sapiens
gctaaagcaaagtccagttgaaaa

SEQ ID NO: 40427 - DNA, 24 bp, Homo sapiens
agctaaagcaaagtccagttgaaa

SEQ ID NO: 40428 - DNA, 24 bp, Homo sapiens
aagctaaagcaaagtccagttgaa

SEQ ID NO: 40429 - DNA, 24 bp, Homo sapiens
caaaaggaaaggtaaaagtaacac

SEQ ID NO: 40430 - DNA, 24 bp, Homo sapiens
gcaaaaggaaaggtaaaagtaaca

SEQ ID NO: 40431 - DNA, 24 bp, Homo sapiens
ggcaaaaggaaaggtaaaagtaac

SEQ ID NO: 40432 - DNA, 24 bp, Homo sapiens
agacatgcgaagttaaagtaaaaa

SEQ ID NO: 40433 - DNA, 24 bp, Homo sapiens
aagacatgcgaagttaaagtaaaa

SEQ ID NO: 40434 - DNA, 24 bp, Homo sapiens
aaagacatgcgaagttaaagtaaa

SEQ ID NO: 40435 - DNA, 23 bp, Homo sapiens
ctatcctcccacctcagcctctc

SEQ ID NO: 40436 - DNA, 25 bp, Homo sapiens
cacttccttctctggtctctgtcac

SEQ ID NO: 40437 - DNA, 23 bp, Homo sapiens
agtgtagtggcgcaatctcagct

SEQ ID NO: 40438 - DNA, 24 bp, Homo sapiens
catcctttcaggaagggcctgcaa

SEQ ID NO: 40439 - DNA, 24 bp, Homo sapiens
gcatcctttcaggaagggcctgca

SEQ ID NO: 40440 - DNA, 24 bp, Homo sapiens
tgcatcctttcaggaagggcctgc

SEQ ID NO: 40441 - DNA, 24 bp, Homo sapiens
acatcggcatcgacaccatcatcg

SEQ ID NO: 40442 - DNA, 23 bp, Homo sapiens
ccatgagcatcaactccaacctg

SEQ ID NO: 40443 - DNA, 23 bp, Homo sapiens
gagaccaggacggacgcagccat

SEQ ID NO: 40444 - DNA, 24 bp, Homo sapiens
cttttctacaggatgaatttttag

SEQ ID NO: 40445 - DNA, 24 bp, Homo sapiens
tcttttctacaggatgaattttta

SEQ ID NO: 40446 - DNA, 24 bp, Homo sapiens
gtcttttctacaggatgaattttt

SEQ ID NO: 40447 - DNA, 24 bp, Homo sapiens
aactgggaaaggtatcatgattgt

SEQ ID NO: 40448 - DNA, 24 bp, Homo sapiens
taactgggaaaggtatcatgattg

SEQ ID NO: 40449 - DNA, 24 bp, Homo sapiens
ataactgggaaaggtatcatgatt

SEQ ID NO: 40450 - DNA, 24 bp, Homo sapiens
ttgtgattgtggtgagctggagcc

SEQ ID NO: 40451 - DNA, 24 bp, Homo sapiens
agaatgatgctgctcaggaccagt

SEQ ID NO: 40452 - DNA, 24 bp, Homo sapiens
tgttcatagaagcctgttgtgtgc

SEQ ID NO: 40453 - DNA, 24 bp, Homo sapiens
ttctatttcagattcattccactt

SEQ ID NO: 40454 - DNA, 24 bp, Homo sapiens
attctatttcagattcattccact

SEQ ID NO: 40455 - DNA, 24 bp, Homo sapiens
aattctatttcagattcattccac

SEQ ID NO: 40456 - DNA, 24 bp, Homo sapiens
cctatatcatggtgtccaactttc

SEQ ID NO: 40457 - DNA, 24 bp, Homo sapiens
ccctatatcatggtgtccaacttt

SEQ ID NO: 40458 - DNA, 24 bp, Homo sapiens
tccctatatcatggtgtccaactt

SEQ ID NO: 40459 - DNA, 24 bp, Homo sapiens
aatgttcacaaaatttccgtgaat

SEQ ID NO: 40460 - DNA, 24 bp, Homo sapiens
taatgttcacaaaatttccgtgaa

SEQ ID NO: 40461 - DNA, 24 bp, Homo sapiens
ttaatgttcacaaaatttccgtga

SEQ ID NO: 40462 - DNA, 25 bp, Homo sapiens
aggattggacgcagtaggtagaagg

SEQ ID NO: 40463 - DNA, 23 bp, Homo sapiens
gcagcagtagctcagcgattggc

SEQ ID NO: 40464 - DNA, 23 bp, Homo sapiens
ggacggacagggcagctcaagac

SEQ ID NO: 40465 - DNA, 24 bp, Homo sapiens
gcagcctggagattgagcagtgag

SEQ ID NO: 40466 - DNA, 25 bp, Homo sapiens
actcctatggtcacagacttctggc

SEQ ID NO: 40467 - DNA, 25 bp, Homo sapiens
cgccttcaggagaatctacacgcat

SEQ ID NO: 40468 - DNA, 24 bp, Homo sapiens
tttcaaggaagtggaaggacagtc

SEQ ID NO: 40469 - DNA, 24 bp, Homo sapiens
ttttcaaggaagtggaaggacagt

SEQ ID NO: 40470 - DNA, 24 bp, Homo sapiens
gttttcaaggaagtggaaggacag

SEQ ID NO: 40471 - DNA, 24 bp, Homo sapiens
cttcgtgggcacaaggtcctacat

SEQ ID NO: 40472 - DNA, 24 bp, Homo sapiens
ggtagagatggcggttgggaggta

SEQ ID NO: 40473 - DNA, 24 bp, Homo sapiens
ggtggaaggagatgcggctgagac

SEQ ID NO: 40474 - DNA, 24 bp, Homo sapiens
cgctcccggcccgccccctatggg

SEQ ID NO: 40475 - DNA, 24 bp, Homo sapiens
aggcccgcagcgccgcccgccctc

SEQ ID NO: 40476 - DNA, 24 bp, Homo sapiens
ggccgcagccccgggctcgcgtag

SEQ ID NO: 40477 - DNA, 23 bp, Homo sapiens
ggcatgtagtagcggtggtgctg

SEQ ID NO: 40478 - DNA, 23 bp, Homo sapiens
ctgtgtctgctgctgccgctgct

SEQ ID NO: 40479 - DNA, 23 bp, Homo sapiens
gtatgcagtaccacgcgctgtcg

SEQ ID NO: 40480 - DNA, 23 bp, Homo sapiens
acggcttctcggtgaccctcctg

SEQ ID NO: 40481 - DNA, 23 bp, Homo sapiens
ggcatgtagtagcggtggtgctg

SEQ ID NO: 40482 - DNA, 23 bp, Homo sapiens
ctgtgtctgctgctgccgctgct

SEQ ID NO: 40483 - DNA, 24 bp, Homo sapiens
ttcttttctaggaacacttcattg

SEQ ID NO: 40484 - DNA, 24 bp, Homo sapiens
tttcttttctaggaacacttcatt

SEQ ID NO: 40485 - DNA, 24 bp, Homo sapiens
ctttcttttctaggaacacttcat

SEQ ID NO: 40486 - DNA, 24 bp, Homo sapiens
actgtggcacctctgagtgttcct

SEQ ID NO: 40487 - DNA, 23 bp, Homo sapiens
ctgttgctgtgtgccctcttgga

SEQ ID NO: 40488 - DNA, 24 bp, Homo sapiens
gtggttggaggatatgacggacat

SEQ ID NO: 40489 - DNA, 24 bp, Homo sapiens
ccaatggccagatgaatgaacaag

SEQ ID NO: 40490 - DNA, 24 bp, Homo sapiens
gccaatggccagatgaatgaacaa

SEQ ID NO: 40491 - DNA, 24 bp, Homo sapiens
agccaatggccagatgaatgaaca

SEQ ID NO: 40492 - DNA, 24 bp, Homo sapiens
tagcagtttctgtgagtacatttt

SEQ ID NO: 40493 - DNA, 24 bp, Homo sapiens
atagcagtttctgtgagtacattt

SEQ ID NO: 40494 - DNA, 24 bp, Homo sapiens
aatagcagtttctgtgagtacatt

SEQ ID NO: 40495 - DNA, 24 bp, Homo sapiens
ccgcagcatggagagcattgagat

SEQ ID NO: 40496 - DNA, 24 bp, Homo sapiens
gcagccgctcgccatcctcagaga

SEQ ID NO: 40497 - DNA, 24 bp, Homo sapiens
tcgacctcaacctggatatcagcc

SEQ ID NO: 40498 - DNA, 24 bp, Homo sapiens
ggcaccagcggctcccaaaatggc

SEQ ID NO: 40499 - DNA, 24 bp, Homo sapiens
cggcaccagcggctcccaaaatgg

SEQ ID NO: 40500 - DNA, 24 bp, Homo sapiens
cggcaccagcggctcccaaaatgg

SEQ ID NO: 40501 - DNA, 24 bp, Homo sapiens
acagaaaaaaagtaagtgatagtg

SEQ ID NO: 40502 - DNA, 24 bp, Homo sapiens
aacagaaaaaaagtaagtgatagt

SEQ ID NO: 40503 - DNA, 24 bp, Homo sapiens
aaacagaaaaaaagtaagtgatag

SEQ ID NO: 40504 - DNA, 24 bp, Homo sapiens
tactttaacagcacctttggattt

SEQ ID NO: 40505 - DNA, 24 bp, Homo sapiens
ttactttaacagcacctttggatt

SEQ ID NO: 40506 - DNA, 24 bp, Homo sapiens
attactttaacagcacctttggat

SEQ ID NO: 40507 - DNA, 24 bp, Homo sapiens
ccaagacaaaggcaatggacggcg

SEQ ID NO: 40508 - DNA, 24 bp, Homo sapiens
tccaagacaaaggcaatggacggc

SEQ ID NO: 40509 - DNA, 24 bp, Homo sapiens
ttccaagacaaaggcaatggacgg

SEQ ID NO: 40510 - DNA, 24 bp, Homo sapiens
cggagacaacggaaggatggtgtg

SEQ ID NO: 40511 - DNA, 24 bp, Homo sapiens
ttacactctggtgataagcacggc

SEQ ID NO: 40512 - DNA, 24 bp, Homo sapiens
acaacatcaccatcaccgtcaccg

SEQ ID NO: 40513 - DNA, 23 bp, Homo sapiens
ccgtgctggtgtcgctggtggaa

SEQ ID NO: 40514 - DNA, 25 bp, Homo sapiens
ggtgtccagtctgttggtgcttacc

SEQ ID NO: 40515 - DNA, 23 bp, Homo sapiens
ggtgagatcagcacgacacgagc

SEQ ID NO: 40516 - DNA, 24 bp, Homo sapiens
tggtcatactcgcaacaacagccg

SEQ ID NO: 40517 - DNA, 23 bp, Homo sapiens
cggttctggtgtcgctggtggag

SEQ ID NO: 40518 - DNA, 23 bp, Homo sapiens
ctggtgctcacgctgctgctgta

SEQ ID NO: 40519 - DNA, 24 bp, Homo sapiens
aataccagtagccagggaagacct

SEQ ID NO: 40520 - DNA, 24 bp, Homo sapiens
aaataccagtagccagggaagacc

SEQ ID NO: 40521 - DNA, 24 bp, Homo sapiens
aaaataccagtagccagggaagac

SEQ ID NO: 40522 - DNA, 24 bp, Homo sapiens
gttttgggaagttttatcttactg

SEQ ID NO: 40523 - DNA, 24 bp, Homo sapiens
ggttttgggaagttttatcttact

SEQ ID NO: 40524 - DNA, 24 bp, Homo sapiens
tggttttgggaagttttatcttac

SEQ ID NO: 40525 - DNA, 23 bp, Homo sapiens
acctccgcctcctgtgttcaagc

SEQ ID NO: 40526 - DNA, 25 bp, Homo sapiens
tgatagactcttcagcgacatagca

SEQ ID NO: 40527 - DNA, 25 bp, Homo sapiens
gcacttaccataggaggaggttggc

SEQ ID NO: 40528 - DNA, 24 bp, Homo sapiens
aacaattgcaacaaatgtatgcac

SEQ ID NO: 40529 - DNA, 24 bp, Homo sapiens
aaacaattgcaacaaatgtatgca

SEQ ID NO: 40530 - DNA, 24 bp, Homo sapiens
gaaacaattgcaacaaatgtatgc

SEQ ID NO: 40531 - DNA, 24 bp, Homo sapiens
ttgctttgtagagatctgatctaa

SEQ ID NO: 40532 - DNA, 24 bp, Homo sapiens
attgctttgtagagatctgatcta

SEQ ID NO: 40533 - DNA, 24 bp, Homo sapiens
gattgctttgtagagatctgatct

SEQ ID NO: 40534 - DNA, 24 bp, Homo sapiens
ttctccacatcctctccagcatct

SEQ ID NO: 40535 - DNA, 25 bp, Homo sapiens
tcgtcttccacaatggttgaactaa

SEQ ID NO: 40536 - DNA, 23 bp, Homo sapiens
ttcccaccaacactgtgaaagtg

SEQ ID NO: 40537 - DNA, 24 bp, Homo sapiens
caaatacacaagtaaggttctttt

SEQ ID NO: 40538 - DNA, 24 bp, Homo sapiens
ccaaatacacaagtaaggttcttt

SEQ ID NO: 40539 - DNA, 24 bp, Homo sapiens
gccaaatacacaagtaaggttctt

SEQ ID NO: 40540 - DNA, 24 bp, Homo sapiens
agccataatgggtaagagtaatta

SEQ ID NO: 40541 - DNA, 24 bp, Homo sapiens
aagccataatgggtaagagtaatt

SEQ ID NO: 40542 - DNA, 24 bp, Homo sapiens
gaagccataatgggtaagagtaat

SEQ ID NO: 40543 - DNA, 25 bp, Homo sapiens
ggctgatcttgaactcctgacctcg

SEQ ID NO: 40544 - DNA, 25 bp, Homo sapiens
ccgcagaggtctgaagattggaagg

SEQ ID NO: 40545 - DNA, 25 bp, Homo sapiens
tgatctggtcctggagtttgtctga

SEQ ID NO: 40546 - DNA, 25 bp, Homo sapiens
acctattgagtgccaccaaattacg

SEQ ID NO: 40547 - DNA, 25 bp, Homo sapiens
tgctatttctctacaggacaaaggg

SEQ ID NO: 40548 - DNA, 25 bp, Homo sapiens
gctgatcttgaactcctgacctcgg

SEQ ID NO: 40549 - DNA, 24 bp, Homo sapiens
ttttattccaggcagttaaaagaa

SEQ ID NO: 40550 - DNA, 24 bp, Homo sapiens
gttttattccaggcagttaaaaga

SEQ ID NO: 40551 - DNA, 24 bp, Homo sapiens
tgttttattccaggcagttaaaag

SEQ ID NO: 40552 - DNA, 25 bp, Homo sapiens
ggattggcctggacagactgttctc

SEQ ID NO: 40553 - DNA, 25 bp, Homo sapiens
ttggacaaaagaagtacaaacagct

SEQ ID NO: 40554 - DNA, 25 bp, Homo sapiens
tgcctatacaaaatatgaacgaatt

SEQ ID NO: 40555 - DNA, 23 bp, Homo sapiens
gaggtggcaggcagcaaggagag

SEQ ID NO: 40556 - DNA, 23 bp, Homo sapiens
aggaaccttaggagcacagtggc

SEQ ID NO: 40557 - DNA, 25 bp, Homo sapiens
ggtctgctaaggaatggagaacttc

SEQ ID NO: 40558 - DNA, 24 bp, Homo sapiens
caatacaagtggtatgtgttttat

SEQ ID NO: 40559 - DNA, 24 bp, Homo sapiens
acaatacaagtggtatgtgtttta

SEQ ID NO: 40560 - DNA, 24 bp, Homo sapiens
aacaatacaagtggtatgtgtttt

SEQ ID NO: 40561 - DNA, 24 bp, Homo sapiens
caacaactttgaccttatttaatc

SEQ ID NO: 40562 - DNA, 24 bp, Homo sapiens
gcaacaactttgaccttatttaat

SEQ ID NO: 40563 - DNA, 24 bp, Homo sapiens
tgcaacaactttgaccttatttaa

SEQ ID NO: 40564 - DNA, 23 bp, Homo sapiens
cgctggtctccgctcgggtgagg

SEQ ID NO: 40565 - DNA, 23 bp, Homo sapiens
ggtcgggaccccagtgaggaggg

SEQ ID NO: 40566 - DNA, 23 bp, Homo sapiens
ctcgggtcccaggcgcaagggtg

SEQ ID NO: 40567 - DNA, 24 bp, Homo sapiens
aggagaagaagaatttggaatttt

SEQ ID NO: 40568 - DNA, 24 bp, Homo sapiens
aaggagaagaagaatttggaattt

SEQ ID NO: 40569 - DNA, 24 bp, Homo sapiens
caaggagaagaagaatttggaatt

SEQ ID NO: 40570 - DNA, 24 bp, Homo sapiens
atgattcttaggataaggaggtag

SEQ ID NO: 40571 - DNA, 24 bp, Homo sapiens
tatgattcttaggataaggaggta

SEQ ID NO: 40572 - DNA, 24 bp, Homo sapiens
gtatgattcttaggataaggaggt

SEQ ID NO: 40573 - DNA, 23 bp, Homo sapiens
cccatcttcctcctcccgacatc

SEQ ID NO: 40574 - DNA, 23 bp, Homo sapiens
acttccagcaagtcggaggcagg

SEQ ID NO: 40575 - DNA, 23 bp, Homo sapiens
ccaccaccaccacccactgcctg

SEQ ID NO: 40576 - DNA, 23 bp, Homo sapiens
cagcctcagcaccgacagccgac

SEQ ID NO: 40577 - DNA, 25 bp, Homo sapiens
atggagcaaaaggaatgccaggatc

SEQ ID NO: 40578 - DNA, 23 bp, Homo sapiens
ggcgcggcgagcccagggaggca

SEQ ID NO: 40579 - DNA, 24 bp, Homo sapiens
cctctgtttagctacttttccagg

SEQ ID NO: 40580 - DNA, 24 bp, Homo sapiens
tcctctgtttagctacttttccag

SEQ ID NO: 40581 - DNA, 24 bp, Homo sapiens
ctcctctgtttagctacttttcca

SEQ ID NO: 40582 - DNA, 24 bp, Homo sapiens
gtcttgtgaagatatagatgaatg

SEQ ID NO: 40583 - DNA, 24 bp, Homo sapiens
agtcttgtgaagatatagatgaat

SEQ ID NO: 40584 - DNA, 24 bp, Homo sapiens
aagtcttgtgaagatatagatgaa

SEQ ID NO: 40585 - DNA, 24 bp, Homo sapiens
ttctatatgctttttgtcaaagca

SEQ ID NO: 40586 - DNA, 24 bp, Homo sapiens
attctatatgctttttgtcaaagc

SEQ ID NO: 40587 - DNA, 24 bp, Homo sapiens
tattctatatgctttttgtcaaag

SEQ ID NO: 40588 - DNA, 24 bp, Homo sapiens
cctggaggttacacttgctattgt

SEQ ID NO: 40589 - DNA, 24 bp, Homo sapiens
ggttgtttcagtgtgccttccctt

SEQ ID NO: 40590 - DNA, 24 bp, Homo sapiens
tactttacttggcggagcagtttg

SEQ ID NO: 40591 - DNA, 24 bp, Homo sapiens
agattgtaaagatatagatgaatg

SEQ ID NO: 40592 - DNA, 24 bp, Homo sapiens
aagattgtaaagatatagatgaat

SEQ ID NO: 40593 - DNA, 24 bp, Homo sapiens
aaagattgtaaagatatagatgaa

SEQ ID NO: 40594 - DNA, 23 bp, Homo sapiens
gccaagaagggaatgctgaaggg

SEQ ID NO: 40595 - DNA, 25 bp, Homo sapiens
gcggtagatgatgatgatgaaggca

SEQ ID NO: 40596 - DNA, 24 bp, Homo sapiens
gttgccgaggtgactttgaatggg

SEQ ID NO: 40597 - DNA, 25 bp, Homo sapiens
aggagcaggagaggattcaagccaa

SEQ ID NO: 40598 - DNA, 25 bp, Homo sapiens
atggctctcaacgctagacctcaga

SEQ ID NO: 40599 - DNA, 24 bp, Homo sapiens
tgtatgcccaagtcaagaagccgc

SEQ ID NO: 40600 - DNA, 24 bp, Homo sapiens
gtcacaggcagggccatggagttg

SEQ ID NO: 40601 - DNA, 24 bp, Homo sapiens
ggtcacaggcagggccatggagtt

SEQ ID NO: 40602 - DNA, 24 bp, Homo sapiens
gggtcacaggcagggccatggagt

SEQ ID NO: 40603 - DNA, 24 bp, Homo sapiens
ctcagatacagggaaaacattgcc

SEQ ID NO: 40604 - DNA, 24 bp, Homo sapiens
tctcagatacagggaaaacattgc

SEQ ID NO: 40605 - DNA, 24 bp, Homo sapiens
ttctcagatacagggaaaacattg

SEQ ID NO: 40606 - DNA, 24 bp, Homo sapiens
ctggcctccaccgacaccagctct

SEQ ID NO: 40607 - DNA, 24 bp, Homo sapiens
cctggcctccaccgacaccagctc

SEQ ID NO: 40608 - DNA, 24 bp, Homo sapiens
gcctggcctccaccgacaccagct

SEQ ID NO: 40609 - DNA, 24 bp, Homo sapiens
gaatctgaccgccgccactctcaa

SEQ ID NO: 40610 - DNA, 24 bp, Homo sapiens
cctttcgtctccgcagtcccacac

SEQ ID NO: 40611 - DNA, 24 bp, Homo sapiens
cttcctttcccacggctggagttg

SEQ ID NO: 40612 - DNA, 24 bp, Homo sapiens
ctagagaggccgccaggagacccg

SEQ ID NO: 40613 - DNA, 24 bp, Homo sapiens
aaaggaggttgtccataattgact

SEQ ID NO: 40614 - DNA, 24 bp, Homo sapiens
agcaatcagtaaaacattgagctc

SEQ ID NO: 40615 - DNA, 24 bp, Homo sapiens
ggacttggtggatggacggcattc

SEQ ID NO: 40616 - DNA, 24 bp, Homo sapiens
attgcagtgattcatggagaggcg

SEQ ID NO: 40617 - DNA, 24 bp, Homo sapiens
caagtctccagcctcggcgaagag

SEQ ID NO: 40618 - DNA, 24 bp, Homo sapiens
aagaaatccacctccccaacccca

SEQ ID NO: 40619 - DNA, 24 bp, Homo sapiens
ctagggaatcatcatccagggacg

SEQ ID NO: 40620 - DNA, 24 bp, Homo sapiens
agacagggcaacattgagcgtgag

SEQ ID NO: 40621 - DNA, 24 bp, Homo sapiens
atcctcccatctcagcctcccaag

SEQ ID NO: 40622 - DNA, 24 bp, Homo sapiens
actcctggactcaagtgatcctcc

SEQ ID NO: 40623 - DNA, 24 bp, Homo sapiens
tggacacaggtcagacagtgcaga

SEQ ID NO: 40624 - DNA, 23 bp, Homo sapiens
cgtcgtgggtgtttggtgtgagg

SEQ ID NO: 40625 - DNA, 23 bp, Homo sapiens
gtcactcaccgccgccgccgcca

SEQ ID NO: 40626 - DNA, 23 bp, Homo sapiens
gccgccgcgagttctcacggtcc

SEQ ID NO: 40627 - DNA, 23 bp, Homo sapiens
gcagtggcacaatcttggctcac

SEQ ID NO: 40628 - DNA, 23 bp, Homo sapiens
ccactgccaccacggtcgcctgc

SEQ ID NO: 40629 - DNA, 23 bp, Homo sapiens
cgtcgtgggtgtttggtgtgagg

SEQ ID NO: 40630 - DNA, 24 bp, Homo sapiens
gtgcctggacgctcctgtgctgag

SEQ ID NO: 40631 - DNA, 24 bp, Homo sapiens
taagtgtgaagcctcctaccctgg

SEQ ID NO: 40632 - DNA, 24 bp, Homo sapiens
gttctgtgtgggcttccttgaggg

SEQ ID NO: 40633 - DNA, 24 bp, Homo sapiens
tccttttctgggagtttgtcttgg

SEQ ID NO: 40634 - DNA, 24 bp, Homo sapiens
ttccttttctgggagtttgtcttg

SEQ ID NO: 40635 - DNA, 24 bp, Homo sapiens
attccttttctgggagtttgtctt

SEQ ID NO: 40636 - DNA, 25 bp, Homo sapiens
acattgaccatttccttcaccctgc

SEQ ID NO: 40637 - DNA, 23 bp, Homo sapiens
acctcctttctgtcaatccaccc

SEQ ID NO: 40638 - DNA, 23 bp, Homo sapiens
acactcctgtaaccattatccca

SEQ ID NO: 40639 - DNA, 24 bp, Homo sapiens
cgcacctgaaggaaagaacaaggg

SEQ ID NO: 40640 - DNA, 24 bp, Homo sapiens
acgcacctgaaggaaagaacaagg

SEQ ID NO: 40641 - DNA, 24 bp, Homo sapiens
cacgcacctgaaggaaagaacaag

SEQ ID NO: 40642 - DNA, 23 bp, Homo sapiens
cgcttcggctacatcctccacac

SEQ ID NO: 40643 - DNA, 25 bp, Homo sapiens
caactacattggcggctactactgc

SEQ ID NO: 40644 - DNA, 24 bp, Homo sapiens
cgaggagctgtcctgtgaccacta

SEQ ID NO: 40645 - DNA, 25 bp, Homo sapiens
tgaagttggtgagcattccattacc

SEQ ID NO: 40646 - DNA, 24 bp, Homo sapiens
ctgttcgactgatagctcatccgc

SEQ ID NO: 40647 - DNA, 23 bp, Homo sapiens
ctaccacagcagcagccacgtca

SEQ ID NO: 40648 - DNA, 23 bp, Homo sapiens
cacagaggtcggcaggcagcaca

SEQ ID NO: 40649 - DNA, 23 bp, Homo sapiens
cggctggctggctcgctctctcc

SEQ ID NO: 40650 - DNA, 23 bp, Homo sapiens
tgtggtgacacacgctgtagctg

SEQ ID NO: 40651 - DNA, 24 bp, Homo sapiens
tcattcttcaggttcctgcttggc

SEQ ID NO: 40652 - DNA, 24 bp, Homo sapiens
ttcattcttcaggttcctgcttgg

SEQ ID NO: 40653 - DNA, 24 bp, Homo sapiens
cttcattcttcaggttcctgcttg

SEQ ID NO: 40654 - DNA, 24 bp, Homo sapiens
aagaataccaggctcagcgatatg

SEQ ID NO: 40655 - DNA, 24 bp, Homo sapiens
gaagaataccaggctcagcgatat

SEQ ID NO: 40656 - DNA, 24 bp, Homo sapiens
tgaagaataccaggctcagcgata

SEQ ID NO: 40657 - DNA, 25 bp, Homo sapiens
tcggatgaggagaatgaggacggag

SEQ ID NO: 40658 - DNA, 23 bp, Homo sapiens
gcataaagagccacccaaggagc

SEQ ID NO: 40659 - DNA, 24 bp, Homo sapiens
ctaccagcaccaacggcaacagat

SEQ ID NO: 40660 - DNA, 23 bp, Homo sapiens
aggctggagtgtaatggcgtgat

SEQ ID NO: 40661 - DNA, 25 bp, Homo sapiens
tctgtctgtgaggattatggaccag

SEQ ID NO: 40662 - DNA, 25 bp, Homo sapiens
acaacaagtaacgtggaagctctga

SEQ ID NO: 40663 - DNA, 23 bp, Homo sapiens
gcaacgcacagcacaagcaatgc

SEQ ID NO: 40664 - DNA, 24 bp, Homo sapiens
aggaagatgctaatgggaactgcc

SEQ ID NO: 40665 - DNA, 24 bp, Homo sapiens
gcatttggctacagtggactcgac

SEQ ID NO: 40666 - DNA, 23 bp, Homo sapiens
ctagtcctggctgggctcccgct

SEQ ID NO: 40667 - DNA, 23 bp, Homo sapiens
gagcggtggtctccagggaggtc

SEQ ID NO: 40668 - DNA, 25 bp, Homo sapiens
ggtagatgaaaatggaaggggcggg

SEQ ID NO: 40669 - DNA, 24 bp, Homo sapiens
tttcttgccagtgtgctggaaagg

SEQ ID NO: 40670 - DNA, 24 bp, Homo sapiens
gtttcttgccagtgtgctggaaag

SEQ ID NO: 40671 - DNA, 24 bp, Homo sapiens
ggtttcttgccagtgtgctggaaa

SEQ ID NO: 40672 - DNA, 23 bp, Homo sapiens
gctcaggaacaggcttctggcag

SEQ ID NO: 40673 - DNA, 25 bp, Homo sapiens
gtggtcgttctttgtcctcctgagc

SEQ ID NO: 40674 - DNA, 23 bp, Homo sapiens
cggcggcagtggagcgagagatg

SEQ ID NO: 40675 - DNA, 24 bp, Homo sapiens
cctccctgcacagagcacatcaaa

SEQ ID NO: 40676 - DNA, 24 bp, Homo sapiens
cacaggcagcagagaccatggggc

SEQ ID NO: 40677 - DNA, 24 bp, Homo sapiens
agctgacagccgtgctcaggaagt

SEQ ID NO: 40678 - DNA, 24 bp, Homo sapiens
aaaatgccaagcattacttttaaa

SEQ ID NO: 40679 - DNA, 24 bp, Homo sapiens
aaaaatgccaagcattacttttaa

SEQ ID NO: 40680 - DNA, 24 bp, Homo sapiens
gaaaaatgccaagcattactttta

SEQ ID NO: 40681 - DNA, 24 bp, Homo sapiens
agcgaggtgataggactagaggag

SEQ ID NO: 40682 - DNA, 24 bp, Homo sapiens
agaatcttgctggctacatctggt

SEQ ID NO: 40683 - DNA, 24 bp, Homo sapiens
tgaagccctgccacccaaagtttc

SEQ ID NO: 40684 - DNA, 23 bp, Homo sapiens
ccttacaagcctgtccaccagcc

SEQ ID NO: 40685 - DNA, 23 bp, Homo sapiens
tacagcagcagcagcaacagtgg

SEQ ID NO: 40686 - DNA, 23 bp, Homo sapiens
ccagtgaccagtcctctccgtcc

SEQ ID NO: 40687 - DNA, 23 bp, Homo sapiens
tacagcagcagcagcaacagtgg

SEQ ID NO: 40688 - DNA, 23 bp, Homo sapiens
ccagtgaccagtcctctccgtcc

SEQ ID NO: 40689 - DNA, 23 bp, Homo sapiens
ccgaggcagcccactttctgttt

SEQ ID NO: 40690 - DNA, 23 bp, Homo sapiens
cgtcctgagagtcagccctcgcc

SEQ ID NO: 40691 - DNA, 23 bp, Homo sapiens
cccagtgcgctgcgggccgaggc

SEQ ID NO: 40692 - DNA, 23 bp, Homo sapiens
catggagcgccccccgccccgcg

SEQ ID NO: 40693 - DNA, 23 bp, Homo sapiens
tacagcagcagcagcaacagtgg

SEQ ID NO: 40694 - DNA, 23 bp, Homo sapiens
ccagtgaccagtcctctccgtcc

SEQ ID NO: 40695 - DNA, 24 bp, Homo sapiens
ccaggtcatgttccagtgtctgtg

SEQ ID NO: 40696 - DNA, 25 bp, Homo sapiens
aaatacggaacccagtgagtgccag

SEQ ID NO: 40697 - DNA, 25 bp, Homo sapiens
tcagaacctccctatgactcacagg

SEQ ID NO: 40698 - DNA, 24 bp, Homo sapiens
caaagtatattgcaggaccctatg

SEQ ID NO: 40699 - DNA, 23 bp, Homo sapiens
gagttctcgccagcttcgggttc

SEQ ID NO: 40700 - DNA, 23 bp, Homo sapiens
gctcccgccgccgtcctgttccc

SEQ ID NO: 40701 - DNA, 23 bp, Homo sapiens
gtcgcggctccgtttatccctcc

SEQ ID NO: 40702 - DNA, 24 bp, Homo sapiens
aagtgatcctcctgccttggactc

SEQ ID NO: 40703 - DNA, 25 bp, Homo sapiens
ctggcccctcaattcctcaaaagct

SEQ ID NO: 40704 - DNA, 23 bp, Homo sapiens
tgctgggattacaggcctctgcc

SEQ ID NO: 40705 - DNA, 24 bp, Homo sapiens
ttgcattgaaagtaagtacagtaa

SEQ ID NO: 40706 - DNA, 24 bp, Homo sapiens
gttgcattgaaagtaagtacagta

SEQ ID NO: 40707 - DNA, 24 bp, Homo sapiens
ggttgcattgaaagtaagtacagt

SEQ ID NO: 40708 - DNA, 23 bp, Homo sapiens
tgggcactgtgaagatgagggct

SEQ ID NO: 40709 - DNA, 25 bp, Homo sapiens
ttgcctctcggtcctacttctttga

SEQ ID NO: 40710 - DNA, 23 bp, Homo sapiens
gagcaccagccacatcctcaatg

SEQ ID NO: 40711 - DNA, 24 bp, Homo sapiens
gctctggctggtgcttctgtatgg

SEQ ID NO: 40712 - DNA, 23 bp, Homo sapiens
ccttctggcttctctactgctgc

SEQ ID NO: 40713 - DNA, 25 bp, Homo sapiens
gcagttcttcaccttgacgcttatg

SEQ ID NO: 40714 - DNA, 24 bp, Homo sapiens
cacgctttgccctcacccttacat

SEQ ID NO: 40715 - DNA, 23 bp, Homo sapiens
catggcgagtttggctcctaccc

SEQ ID NO: 40716 - DNA, 23 bp, Homo sapiens
cagaggagcagcaggaccagagg

SEQ ID NO: 40717 - DNA, 24 bp, Homo sapiens
aaacaagaaaggtaaatttctttt

SEQ ID NO: 40718 - DNA, 24 bp, Homo sapiens
gaaacaagaaaggtaaatttcttt

SEQ ID NO: 40719 - DNA, 24 bp, Homo sapiens
agaaacaagaaaggtaaatttctt

SEQ ID NO: 40720 - DNA, 24 bp, Homo sapiens
atcctcactaacagcaagagccgc

SEQ ID NO: 40721 - DNA, 24 bp, Homo sapiens
ctcagagatgaactcaccaagccg

SEQ ID NO: 40722 - DNA, 25 bp, Homo sapiens
cagcagtagcatctcctccttcagc

SEQ ID NO: 40723 - DNA, 24 bp, Homo sapiens
gcatcacataaaaacgatcttcaa

SEQ ID NO: 40724 - DNA, 24 bp, Homo sapiens
agcatcacataaaaacgatcttca

SEQ ID NO: 40725 - DNA, 24 bp, Homo sapiens
aagcatcacataaaaacgatcttc

SEQ ID NO: 40726 - DNA, 24 bp, Homo sapiens
tcttcctctgattagatggtccac

SEQ ID NO: 40727 - DNA, 23 bp, Homo sapiens
agatctgctgctgctgctactgc

SEQ ID NO: 40728 - DNA, 23 bp, Homo sapiens
ctccccatacgtcaaagagaaga

SEQ ID NO: 40729 - DNA, 24 bp, Homo sapiens
atttagaagaggtaagaccatatc

SEQ ID NO: 40730 - DNA, 24 bp, Homo sapiens
tatttagaagaggtaagaccatat

SEQ ID NO: 40731 - DNA, 24 bp, Homo sapiens
ttatttagaagaggtaagaccata

SEQ ID NO: 40732 - DNA, 24 bp, Homo sapiens
ggtagattttgatttatactatgg

SEQ ID NO: 40733 - DNA, 24 bp, Homo sapiens
gggtagattttgatttatactatg

SEQ ID NO: 40734 - DNA, 24 bp, Homo sapiens
agggtagattttgatttatactat

SEQ ID NO: 40735 - DNA, 24 bp, Homo sapiens
taaatttaaaggtaagtaaacctt

SEQ ID NO: 40736 - DNA, 24 bp, Homo sapiens
ttaaatttaaaggtaagtaaacct

SEQ ID NO: 40737 - DNA, 24 bp, Homo sapiens
attaaatttaaaggtaagtaaacc

SEQ ID NO: 40738 - DNA, 24 bp, Homo sapiens
tcccaccatacccgttagaaggcg

SEQ ID NO: 40739 - DNA, 25 bp, Homo sapiens
gatacagagaacacaagtgaagacg

SEQ ID NO: 40740 - DNA, 25 bp, Homo sapiens
aggaggaggacgacaatgaagagga

SEQ ID NO: 40741 - DNA, 25 bp, Homo sapiens
tctccattctgttccactgctcttc

SEQ ID NO: 40742 - DNA, 23 bp, Homo sapiens
tgtgagtctggcaggcaggagaa

SEQ ID NO: 40743 - DNA, 25 bp, Homo sapiens
agagtgttggagaagaatctgtagc

SEQ ID NO: 40744 - DNA, 24 bp, Homo sapiens
cctcttcagatgctggcagtggaa

SEQ ID NO: 40745 - DNA, 23 bp, Homo sapiens
caccctccaccacgcctgcttca

SEQ ID NO: 40746 - DNA, 23 bp, Homo sapiens
ccctgcccagccctccacctctg

SEQ ID NO: 40747 - DNA, 24 bp, Homo sapiens
agaagtattttttcctgattcact

SEQ ID NO: 40748 - DNA, 24 bp, Homo sapiens
gagaagtattttttcctgattcac

SEQ ID NO: 40749 - DNA, 24 bp, Homo sapiens
cgagaagtattttttcctgattca

SEQ ID NO: 40750 - DNA, 23 bp, Homo sapiens
cctgaagacgatgacgagtgctc

SEQ ID NO: 40751 - DNA, 23 bp, Homo sapiens
ctggaccctcgtgaactggctgt

SEQ ID NO: 40752 - DNA, 24 bp, Homo sapiens
cgatggatgattggtgtgacggaa

SEQ ID NO: 40753 - DNA, 25 bp, Homo sapiens
gcctacctcaagtatgggaaggaaa

SEQ ID NO: 40754 - DNA, 24 bp, Homo sapiens
acggaatgcaccatcttcacggac

SEQ ID NO: 40755 - DNA, 23 bp, Homo sapiens
ctggtgatgctgctggagtggtg

SEQ ID NO: 40756 - DNA, 23 bp, Homo sapiens
gagacggagacggaccgagccac

SEQ ID NO: 40757 - DNA, 23 bp, Homo sapiens
ccccactctggactcccgcgctg

SEQ ID NO: 40758 - DNA, 23 bp, Homo sapiens
cagccgccgccgccccgagcacc

SEQ ID NO: 40759 - DNA, 25 bp, Homo sapiens
agccctccctatgtctgcaaagtga

SEQ ID NO: 40760 - DNA, 23 bp, Homo sapiens
gagaggctgggctgggtggcaca

SEQ ID NO: 40761 - DNA, 23 bp, Homo sapiens
agcccgcaactctccagccgaag

SEQ ID NO: 40762 - DNA, 24 bp, Homo sapiens
ccaggtcaacgctgctcttctgag

SEQ ID NO: 40763 - DNA, 23 bp, Homo sapiens
tgagccacagcagcaacagcagc

SEQ ID NO: 40764 - DNA, 23 bp, Homo sapiens
gcttacctcagtgacggtgacgc

SEQ ID NO: 40765 - DNA, 23 bp, Homo sapiens
ctggcggtgctggctaggttaag

SEQ ID NO: 40766 - DNA, 23 bp, Homo sapiens
gcttacctcagtgacggtgacgc

SEQ ID NO: 40767 - DNA, 23 bp, Homo sapiens
tgagccacagcagcaacagcagc

SEQ ID NO: 40768 - DNA, 23 bp, Homo sapiens
ggagacaggctgcacgacgatcc

SEQ ID NO: 40769 - DNA, 25 bp, Homo sapiens
tcacactcctcctcagttgtctcca

SEQ ID NO: 40770 - DNA, 23 bp, Homo sapiens
agccaaagcacttacaccactgg

SEQ ID NO: 40771 - DNA, 25 bp, Homo sapiens
tggaatcaacaacgaacttaaagag

SEQ ID NO: 40772 - DNA, 24 bp, Homo sapiens
agttctgcatattgcttatttcac

SEQ ID NO: 40773 - DNA, 24 bp, Homo sapiens
gccaccgtgcccggctaaaaagta

SEQ ID NO: 40774 - DNA, 24 bp, Homo sapiens
tatagatatgcttattcttgttga

SEQ ID NO: 40775 - DNA, 23 bp, Homo sapiens
gagcagcacctcacccaccactg

SEQ ID NO: 40776 - DNA, 23 bp, Homo sapiens
actatgcctgtggtgccctctgt

SEQ ID NO: 40777 - DNA, 25 bp, Homo sapiens
tctatgactacgaggcagccgacag

SEQ ID NO: 40778 - DNA, 23 bp, Homo sapiens
accagcagcagcagcgtgtctcc

SEQ ID NO: 40779 - DNA, 24 bp, Homo sapiens
ccgtgtccacaaggaagaagcctc

SEQ ID NO: 40780 - DNA, 25 bp, Homo sapiens
tggagtcatctatggtgaatggagg

SEQ ID NO: 40781 - DNA, 25 bp, Homo sapiens
tggagtcatctatggtgaatggagg

SEQ ID NO: 40782 - DNA, 25 bp, Homo sapiens
tctgagtctgaggaagaaacgctgc

SEQ ID NO: 40783 - DNA, 23 bp, Homo sapiens
accagcagcagcagcgtgtctcc

SEQ ID NO: 40784 - DNA, 23 bp, Homo sapiens
tcctgcccatatcatcaacaccc

SEQ ID NO: 40785 - DNA, 24 bp, Homo sapiens
ccgtgtccacaaggaagaagcctc

SEQ ID NO: 40786 - DNA, 23 bp, Homo sapiens
accagcagcagcagcgtgtctcc

SEQ ID NO: 40787 - DNA, 25 bp, Homo sapiens
gtggaatgcctcgctcttactgtgg

SEQ ID NO: 40788 - DNA, 24 bp, Homo sapiens
ccgtgtccacaaggaagaagcctc

SEQ ID NO: 40789 - DNA, 23 bp, Homo sapiens
accagcagcagcagcgtgtctcc

SEQ ID NO: 40790 - DNA, 24 bp, Homo sapiens
ggtttccagtggtaagtaagggca

SEQ ID NO: 40791 - DNA, 24 bp, Homo sapiens
tggtttccagtggtaagtaagggc

SEQ ID NO: 40792 - DNA, 24 bp, Homo sapiens
atggtttccagtggtaagtaaggg

SEQ ID NO: 40793 - DNA, 24 bp, Homo sapiens
tctttatttagtatttcagtttta

SEQ ID NO: 40794 - DNA, 24 bp, Homo sapiens
atctttatttagtatttcagtttt

SEQ ID NO: 40795 - DNA, 24 bp, Homo sapiens
gatctttatttagtatttcagttt

SEQ ID NO: 40796 - DNA, 25 bp, Homo sapiens
agaagttatgtggaacgaggcagca

SEQ ID NO: 40797 - DNA, 23 bp, Homo sapiens
gctctgtcacgcaggctggaatg

SEQ ID NO: 40798 - DNA, 24 bp, Homo sapiens
ggttggtcttgaacacctggcttc

SEQ ID NO: 40799 - DNA, 24 bp, Homo sapiens
tttatatacagatatgcaatatgc

SEQ ID NO: 40800 - DNA, 24 bp, Homo sapiens
ttttatatacagatatgcaatatg

SEQ ID NO: 40801 - DNA, 24 bp, Homo sapiens
cttttatatacagatatgcaatat

SEQ ID NO: 40802 - DNA, 23 bp, Homo sapiens
cagcccacctgtgccctcatcac

SEQ ID NO: 40803 - DNA, 23 bp, Homo sapiens
tgcgggtgctacagcctcacaac

SEQ ID NO: 40804 - DNA, 23 bp, Homo sapiens
cacctgctagcctgtggcactgg

SEQ ID NO: 40805 - DNA, 24 bp, Homo sapiens
ccattgaaaaggtgtttgtcaaag

SEQ ID NO: 40806 - DNA, 24 bp, Homo sapiens
accattgaaaaggtgtttgtcaaa

SEQ ID NO: 40807 - DNA, 24 bp, Homo sapiens
aaccattgaaaaggtgtttgtcaa

SEQ ID NO: 40808 - DNA, 25 bp, Homo sapiens
tgttagccaggacggtctcaatctc

SEQ ID NO: 40809 - DNA, 24 bp, Homo sapiens
ccttgctgggattacaggcgtgag

SEQ ID NO: 40810 - DNA, 25 bp, Homo sapiens
ccggccagtcttgatcatccttgag

SEQ ID NO: 40811 - DNA, 24 bp, Homo sapiens
tttggtgccagggctgctggtggc

SEQ ID NO: 40812 - DNA, 24 bp, Homo sapiens
ttttggtgccagggctgctggtgg

SEQ ID NO: 40813 - DNA, 24 bp, Homo sapiens
attttggtgccagggctgctggtg

SEQ ID NO: 40814 - DNA, 24 bp, Homo sapiens
tcgccttctgcctctacatgctga

SEQ ID NO: 40815 - DNA, 23 bp, Homo sapiens
gctgctggtgctgttcctctacg

SEQ ID NO: 40816 - DNA, 23 bp, Homo sapiens
ggagcagcatcatggtggaggtg

SEQ ID NO: 40817 - DNA, 24 bp, Homo sapiens
aacatataaaaatgatgcatattt

SEQ ID NO: 40818 - DNA, 24 bp, Homo sapiens
taacatataaaaatgatgcatatt

SEQ ID NO: 40819 - DNA, 24 bp, Homo sapiens
ataacatataaaaatgatgcatat

SEQ ID NO: 40820 - DNA, 24 bp, Homo sapiens
tcagccagaaccagccatctcaga

SEQ ID NO: 40821 - DNA, 24 bp, Homo sapiens
tgagcatgagtgacaacttcaggc

SEQ ID NO: 40822 - DNA, 25 bp, Homo sapiens
gcatccgcaccaatatcaacttcag

SEQ ID NO: 40823 - DNA, 25 bp, Homo sapiens
cgtggtggtgatgatggtgatggtg

SEQ ID NO: 40824 - DNA, 23 bp, Homo sapiens
atcacgtgcctgctgagccacta

SEQ ID NO: 40825 - DNA, 23 bp, Homo sapiens
gtctgcacggtccttcatcagcc

SEQ ID NO: 40826 - DNA, 25 bp, Homo sapiens
ggtgatgatggtgatggtggtggtg

SEQ ID NO: 40827 - DNA, 23 bp, Homo sapiens
gctgtctgcacggtccttcatca

SEQ ID NO: 40828 - DNA, 24 bp, Homo sapiens
gagcacagtgtcaggcaacggaat

SEQ ID NO: 40829 - DNA, 23 bp, Homo sapiens
cgtgcctgctgagccactacaag

SEQ ID NO: 40830 - DNA, 25 bp, Homo sapiens
gtggtggtgatgatggtgatggtgg

SEQ ID NO: 40831 - DNA, 24 bp, Homo sapiens
ctctggtctagcggagctggagtt

SEQ ID NO: 40832 - DNA, 24 bp, Homo sapiens
aaacattctgggtaaatataagga

SEQ ID NO: 40833 - DNA, 24 bp, Homo sapiens
aaaacattctgggtaaatataagg

SEQ ID NO: 40834 - DNA, 24 bp, Homo sapiens
aaaaacattctgggtaaatataag

SEQ ID NO: 40835 - DNA, 25 bp, Homo sapiens
cgtgacactggtgatcgcatacatc

SEQ ID NO: 40836 - DNA, 24 bp, Homo sapiens
cactgactttggctgggaggatgc

SEQ ID NO: 40837 - DNA, 23 bp, Homo sapiens
cgtgcgtgctgggagatcctgtg

SEQ ID NO: 40838 - DNA, 24 bp, Homo sapiens
tatggtgacagactgtggctacac

SEQ ID NO: 40839 - DNA, 24 bp, Homo sapiens
atatggtgacagactgtggctaca

SEQ ID NO: 40840 - DNA, 24 bp, Homo sapiens
gatatggtgacagactgtggctac

SEQ ID NO: 40841 - DNA, 24 bp, Homo sapiens
aaaatcttagggttcatcacaaga

SEQ ID NO: 40842 - DNA, 24 bp, Homo sapiens
gaaaatcttagggttcatcacaag

SEQ ID NO: 40843 - DNA, 24 bp, Homo sapiens
agaaaatcttagggttcatcacaa

SEQ ID NO: 40844 - DNA, 24 bp, Homo sapiens
acagacaacagtaaaggaaaaatt

SEQ ID NO: 40845 - DNA, 24 bp, Homo sapiens
aacagacaacagtaaaggaaaaat

SEQ ID NO: 40846 - DNA, 24 bp, Homo sapiens
caacagacaacagtaaaggaaaaa

SEQ ID NO: 40847 - DNA, 24 bp, Homo sapiens
tttcttcatagcatctcaacagaa

SEQ ID NO: 40848 - DNA, 24 bp, Homo sapiens
ttttcttcatagcatctcaacaga

SEQ ID NO: 40849 - DNA, 24 bp, Homo sapiens
tttttcttcatagcatctcaacag

SEQ ID NO: 40850 - DNA, 24 bp, Homo sapiens
cctaatatttattgttgtggtgct

SEQ ID NO: 40851 - DNA, 24 bp, Homo sapiens
tcctaatatttattgttgtggtgc

SEQ ID NO: 40852 - DNA, 24 bp, Homo sapiens
ctcctaatatttattgttgtggtg

SEQ ID NO: 40853 - DNA, 25 bp, Homo sapiens
acggctttagacctgactatgctgg

SEQ ID NO: 40854 - DNA, 24 bp, Homo sapiens
atgcgtcatcaatgagcacggtaa

SEQ ID NO: 40855 - DNA, 25 bp, Homo sapiens
ctcaccactaaagtcccagatagca

SEQ ID NO: 40856 - DNA, 24 bp, Homo sapiens
ggtcactgccgaggaatgaagaga

SEQ ID NO: 40857 - DNA, 23 bp, Homo sapiens
ccgcctccacctccatcgccgtc

SEQ ID NO: 40858 - DNA, 23 bp, Homo sapiens
ctccgccccggcctagggccttg

SEQ ID NO: 40859 - DNA, 25 bp, Homo sapiens
aagtgcaactctgagttctggagcg

SEQ ID NO: 40860 - DNA, 23 bp, Homo sapiens
cacgccccagcctcagacgacac

SEQ ID NO: 40861 - DNA, 23 bp, Homo sapiens
ttctgtgcagccttgcgcagcta

SEQ ID NO: 40862 - DNA, 24 bp, Homo sapiens
ctctcagcaggcagctgaagttca

SEQ ID NO: 40863 - DNA, 24 bp, Homo sapiens
cctctcagcaggcagctgaagttc

SEQ ID NO: 40864 - DNA, 24 bp, Homo sapiens
acctctcagcaggcagctgaagtt

SEQ ID NO: 40865 - DNA, 23 bp, Homo sapiens
ctccttcacctcgctgtgtctgc

SEQ ID NO: 40866 - DNA, 23 bp, Homo sapiens
gtgaagcggcggcgagaggagaa

SEQ ID NO: 40867 - DNA, 25 bp, Homo sapiens
atgacctcgcataattgactcggaa

SEQ ID NO: 40868 - DNA, 23 bp, Homo sapiens
ccaggcggcgaggagagcggtgc

SEQ ID NO: 40869 - DNA, 23 bp, Homo sapiens
ggagcaccaaccggggacttacc

SEQ ID NO: 40870 - DNA, 23 bp, Homo sapiens
gtgcgctgtcccaggttggaaac

SEQ ID NO: 40871 - DNA, 24 bp, Homo sapiens
aagtgacaaaaatcagcaaggatt

SEQ ID NO: 40872 - DNA, 24 bp, Homo sapiens
aaagtgacaaaaatcagcaaggat

SEQ ID NO: 40873 - DNA, 24 bp, Homo sapiens
aaaagtgacaaaaatcagcaagga

SEQ ID NO: 40874 - DNA, 24 bp, Homo sapiens
gacttgcaaaagtaagattttttt

SEQ ID NO: 40875 - DNA, 24 bp, Homo sapiens
agacttgcaaaagtaagatttttt

SEQ ID NO: 40876 - DNA, 24 bp, Homo sapiens
aagacttgcaaaagtaagattttt

SEQ ID NO: 40877 - DNA, 24 bp, Homo sapiens
acctacgcctggaaagtcagcagt

SEQ ID NO: 40878 - DNA, 25 bp, Homo sapiens
cagaatgaaggagcagttgcgtgaa

SEQ ID NO: 40879 - DNA, 25 bp, Homo sapiens
agacaccacctcactttcaaacaca

SEQ ID NO: 40880 - DNA, 24 bp, Homo sapiens
ttaaaaacaagacaaaaagaagac

SEQ ID NO: 40881 - DNA, 24 bp, Homo sapiens
attaaaaacaagacaaaaagaaga

SEQ ID NO: 40882 - DNA, 24 bp, Homo sapiens
gattaaaaacaagacaaaaagaag

SEQ ID NO: 40883 - DNA, 23 bp, Homo sapiens
gctggctgagggcgctgagcgag

SEQ ID NO: 40884 - DNA, 23 bp, Homo sapiens
gtggcggcggcggggccctcagg

SEQ ID NO: 40885 - DNA, 23 bp, Homo sapiens
ggcaggcgccggggccgggtccg

SEQ ID NO: 40886 - DNA, 24 bp, Homo sapiens
agatttggaaaaggattaaaagaa

SEQ ID NO: 40887 - DNA, 24 bp, Homo sapiens
gagatttggaaaaggattaaaaga

SEQ ID NO: 40888 - DNA, 24 bp, Homo sapiens
tgagatttggaaaaggattaaaag

SEQ ID NO: 40889 - DNA, 24 bp, Homo sapiens
ggctcatgttctacctggctaacg

SEQ ID NO: 40890 - DNA, 24 bp, Homo sapiens
ggctggtggagtctgtgcttgatg

SEQ ID NO: 40891 - DNA, 23 bp, Homo sapiens
ggctggaacctgctgtatggctc

SEQ ID NO: 40892 - DNA, 24 bp, Homo sapiens
ggtggtggcagacaacagaatggt

SEQ ID NO: 40893 - DNA, 25 bp, Homo sapiens
tggtaataagacggacaacacaaga

SEQ ID NO: 40894 - DNA, 23 bp, Homo sapiens
cagcggcttagcaacagaggcat

SEQ ID NO: 40895 - DNA, 25 bp, Homo sapiens
cgaagaacagtccaggtggaatcca

SEQ ID NO: 40896 - DNA, 24 bp, Homo sapiens
ggtggtggcagacaacagaatggt

SEQ ID NO: 40897 - DNA, 25 bp, Homo sapiens
tggtaataagacggacaacacaaga

SEQ ID NO: 40898 - DNA, 25 bp, Homo sapiens
cctgagaccaagccaacatctatgc

SEQ ID NO: 40899 - DNA, 24 bp, Homo sapiens
gcagcaactagaccaactgatacc

SEQ ID NO: 40900 - DNA, 25 bp, Homo sapiens
cggaaacgaggagaagcacatacag

SEQ ID NO: 40901 - DNA, 24 bp, Homo sapiens
tagaacctacgctgaaattttggg

SEQ ID NO: 40902 - DNA, 24 bp, Homo sapiens
tttctcagaccagccgacacttag

SEQ ID NO: 40903 - DNA, 24 bp, Homo sapiens
gctgtaaattcctctctttgtact

SEQ ID NO: 40904 - DNA, 24 bp, Homo sapiens
gaatatcacagaaaagcatggctt

SEQ ID NO: 40905 - DNA, 24 bp, Homo sapiens
agaatatcacagaaaagcatggct

SEQ ID NO: 40906 - DNA, 24 bp, Homo sapiens
cagaatatcacagaaaagcatggc

SEQ ID NO: 40907 - DNA, 25 bp, Homo sapiens
tgtggcagtggtctgggataagtca

SEQ ID NO: 40908 - DNA, 24 bp, Homo sapiens
ggaggctctgaaaggtctggtgga

SEQ ID NO: 40909 - DNA, 25 bp, Homo sapiens
gcaatgtttagtcccaggaagcacc

SEQ ID NO: 40910 - DNA, 24 bp, Homo sapiens
gaggtgctcaagatgtccacggag

SEQ ID NO: 40911 - DNA, 24 bp, Homo sapiens
cacacggctgctggacagtgagat

SEQ ID NO: 40912 - DNA, 24 bp, Homo sapiens
caaagtgaacaagaccctgccgta

SEQ ID NO: 40913 - DNA, 25 bp, Homo sapiens
tgagaagcagccttatatggagcac

SEQ ID NO: 40914 - DNA, 23 bp, Homo sapiens
gctgctcaggctggctggatatg

SEQ ID NO: 40915 - DNA, 23 bp, Homo sapiens
gcgtgatggtgggtgcctgtaat

SEQ ID NO: 40916 - DNA, 24 bp, Homo sapiens
ctaggaaacaacatcttctttttc

SEQ ID NO: 40917 - DNA, 24 bp, Homo sapiens
actaggaaacaacatcttcttttt

SEQ ID NO: 40918 - DNA, 24 bp, Homo sapiens
aactaggaaacaacatcttctttt

SEQ ID NO: 40919 - DNA, 24 bp, Homo sapiens
tatattccagaatgttttgagaga

SEQ ID NO: 40920 - DNA, 24 bp, Homo sapiens
atatattccagaatgttttgagag

SEQ ID NO: 40921 - DNA, 24 bp, Homo sapiens
aatatattccagaatgttttgaga

SEQ ID NO: 40922 - DNA, 24 bp, Homo sapiens
aagtgaaaaagaattctgtagcaa

SEQ ID NO: 40923 - DNA, 24 bp, Homo sapiens
taagtgaaaaagaattctgtagca

SEQ ID NO: 40924 - DNA, 24 bp, Homo sapiens
ttaagtgaaaaagaattctgtagc

SEQ ID NO: 40925 - DNA, 24 bp, Homo sapiens
cttggcatacagtaatatattgtg

SEQ ID NO: 40926 - DNA, 24 bp, Homo sapiens
gcttggcatacagtaatatattgt

SEQ ID NO: 40927 - DNA, 24 bp, Homo sapiens
tgcttggcatacagtaatatattg

SEQ ID NO: 40928 - DNA, 24 bp, Homo sapiens
cttttgataagtttggaagagact

SEQ ID NO: 40929 - DNA, 24 bp, Homo sapiens
acttttgataagtttggaagagac

SEQ ID NO: 40930 - DNA, 24 bp, Homo sapiens
aacttttgataagtttggaagaga

SEQ ID NO: 40931 - DNA, 24 bp, Homo sapiens
gtttcctcattgtaagtctattcc

SEQ ID NO: 40932 - DNA, 24 bp, Homo sapiens
tgtttcctcattgtaagtctattc

SEQ ID NO: 40933 - DNA, 24 bp, Homo sapiens
ctgtttcctcattgtaagtctatt

SEQ ID NO: 40934 - DNA, 23 bp, Homo sapiens
gccagcaccaccaccaccattaa

SEQ ID NO: 40935 - DNA, 23 bp, Homo sapiens
actacctagtcccacctgctggc

SEQ ID NO: 40936 - DNA, 24 bp, Homo sapiens
ggacacactgggaaacaggctgac

SEQ ID NO: 40937 - DNA, 23 bp, Homo sapiens
gccagcaccaccaccaccattaa

SEQ ID NO: 40938 - DNA, 24 bp, Homo sapiens
ggacacactgggaaacaggctgac

SEQ ID NO: 40939 - DNA, 24 bp, Homo sapiens
ggacttctgagctgagaggacctc

SEQ ID NO: 40940 - DNA, 25 bp, Homo sapiens
ttggtggaattgatgctaggatgga

SEQ ID NO: 40941 - DNA, 23 bp, Homo sapiens
gccagcacccagtcttcatcagc

SEQ ID NO: 40942 - DNA, 23 bp, Homo sapiens
ctgctgcctgccaccaccatgtc

SEQ ID NO: 40943 - DNA, 24 bp, Homo sapiens
agatagtaggatcacagatacatt

SEQ ID NO: 40944 - DNA, 24 bp, Homo sapiens
aagatagtaggatcacagatacat

SEQ ID NO: 40945 - DNA, 24 bp, Homo sapiens
aagatagtaggatcacagatacat

SEQ ID NO: 40946 - DNA, 25 bp, Homo sapiens
aagaagaaagaccacacagcctcat

SEQ ID NO: 40947 - DNA, 25 bp, Homo sapiens
ccagaaacagtttttacggcagtca

SEQ ID NO: 40948 - DNA, 25 bp, Homo sapiens
acctgaagtctgaagaatttagaac

SEQ ID NO: 40949 - DNA, 24 bp, Homo sapiens
agatgctattggtaagaataacac

SEQ ID NO: 40950 - DNA, 24 bp, Homo sapiens
tagatgctattggtaagaataaca

SEQ ID NO: 40951 - DNA, 24 bp, Homo sapiens
atagatgctattggtaagaataac

SEQ ID NO: 40952 - DNA, 23 bp, Homo sapiens
gggacaatgtgggactgagcggc

SEQ ID NO: 40953 - DNA, 23 bp, Homo sapiens
ccgtgccgccgccgccgccgccg

SEQ ID NO: 40954 - DNA, 24 bp, Homo sapiens
ctgatgtcactcgcagttgtgagc

SEQ ID NO: 40955 - DNA, 23 bp, Homo sapiens
ctgacagaatgagcggctcggac

SEQ ID NO: 40956 - DNA, 23 bp, Homo sapiens
cctcacgctgcggatgctgatgc

SEQ ID NO: 40957 - DNA, 23 bp, Homo sapiens
tgaacgcatcaccaccatcaccg

SEQ ID NO: 40958 - DNA, 24 bp, Homo sapiens
aacgactaggggtgagtcacgatg

SEQ ID NO: 40959 - DNA, 24 bp, Homo sapiens
gaacgactaggggtgagtcacgat

SEQ ID NO: 40960 - DNA, 24 bp, Homo sapiens
ggaacgactaggggtgagtcacga

SEQ ID NO: 40961 - DNA, 24 bp, Homo sapiens
aacaaaaacagattgcttggtcag

SEQ ID NO: 40962 - DNA, 24 bp, Homo sapiens
taacaaaaacagattgcttggtca

SEQ ID NO: 40963 - DNA, 24 bp, Homo sapiens
ttaacaaaaacagattgcttggtc

SEQ ID NO: 40964 - DNA, 24 bp, Homo sapiens
aatattggaaggtattataatttt

SEQ ID NO: 40965 - DNA, 24 bp, Homo sapiens
gaatattggaaggtattataattt

SEQ ID NO: 40966 - DNA, 24 bp, Homo sapiens
agaatattggaaggtattataatt

SEQ ID NO: 40967 - DNA, 24 bp, Homo sapiens
attacttttagtgaggaaattaaa

SEQ ID NO: 40968 - DNA, 24 bp, Homo sapiens
tattacttttagtgaggaaattaa

SEQ ID NO: 40969 - DNA, 24 bp, Homo sapiens
ttattacttttagtgaggaaatta

SEQ ID NO: 40970 - DNA, 23 bp, Homo sapiens
atggctcgcttcgctctgactgt

SEQ ID NO: 40971 - DNA, 23 bp, Homo sapiens
gcatggagaaacaagatttaaca

SEQ ID NO: 40972 - DNA, 23 bp, Homo sapiens
gggaggtagcccgcagtgcaggg

SEQ ID NO: 40973 - DNA, 23 bp, Homo sapiens
cgtggcgtggtgctactgagaag

SEQ ID NO: 40974 - DNA, 23 bp, Homo sapiens
cgccagtccatacggtgctgtca

SEQ ID NO: 40975 - DNA, 23 bp, Homo sapiens
ccacgctttaccgactgctgacc

SEQ ID NO: 40976 - DNA, 24 bp, Homo sapiens
catctcaaaaggtacttgaatgaa

SEQ ID NO: 40977 - DNA, 24 bp, Homo sapiens
ccatctcaaaaggtacttgaatga

SEQ ID NO: 40978 - DNA, 24 bp, Homo sapiens
tccatctcaaaaggtacttgaatg

SEQ ID NO: 40979 - DNA, 24 bp, Homo sapiens
aaaattcttgggtatagtatattt

SEQ ID NO: 40980 - DNA, 24 bp, Homo sapiens
gaaaattcttgggtatagtatatt

SEQ ID NO: 40981 - DNA, 24 bp, Homo sapiens
agaaaattcttgggtatagtatat

SEQ ID NO: 40982 - DNA, 25 bp, Homo sapiens
tggcttcttcaacaggagatggtca

SEQ ID NO: 40983 - DNA, 25 bp, Homo sapiens
gctgctggcttctttgtatagagac

SEQ ID NO: 40984 - DNA, 25 bp, Homo sapiens
ttgtggaagcgttatttcagaggga

SEQ ID NO: 40985 - DNA, 24 bp, Homo sapiens
aagagttttacttaccccaacaag

SEQ ID NO: 40986 - DNA, 24 bp, Homo sapiens
aaagagttttacttaccccaacaa

SEQ ID NO: 40987 - DNA, 24 bp, Homo sapiens
aaaagagttttacttaccccaaca

SEQ ID NO: 40988 - DNA, 24 bp, Homo sapiens
ggcacccagaccaccactcatttg

SEQ ID NO: 40989 - DNA, 24 bp, Homo sapiens
agatgcccttgtcctcagaaccca

SEQ ID NO: 40990 - DNA, 24 bp, Homo sapiens
gcccatcaaatctctgtgcctgct

SEQ ID NO: 40991 - DNA, 24 bp, Homo sapiens
gcccggagcaggtcacgatgaggg

SEQ ID NO: 40992 - DNA, 24 bp, Homo sapiens
agcccggagcaggtcacgatgagg

SEQ ID NO: 40993 - DNA, 24 bp, Homo sapiens
cagcccggagcaggtcacgatgag

SEQ ID NO: 40994 - DNA, 24 bp, Homo sapiens
gcccccagcagacccaggatcctt

SEQ ID NO: 40995 - DNA, 24 bp, Homo sapiens
agcccccagcagacccaggatcct

SEQ ID NO: 40996 - DNA, 24 bp, Homo sapiens
cagcccccagcagacccaggatcc

SEQ ID NO: 40997 - DNA, 23 bp, Homo sapiens
ctgctggaggtggtgctgtttgg

SEQ ID NO: 40998 - DNA, 23 bp, Homo sapiens
gctcatctcctttggtgccgtcc

SEQ ID NO: 40999 - DNA, 23 bp, Homo sapiens
gggctttctccactccttccacg

SEQ ID NO: 41000 - DNA, 25 bp, Homo sapiens
cacctttgccttgtcagcccttgta

SEQ ID NO: 41001 - DNA, 25 bp, Homo sapiens
tctaccattcagacctcttcgccat

SEQ ID NO: 41002 - DNA, 23 bp, Homo sapiens
ggagaagagcaagcaccgccagg

SEQ ID NO: 41003 - DNA, 23 bp, Homo sapiens
gctcaccacaacctctgcctcct

SEQ ID NO: 41004 - DNA, 25 bp, Homo sapiens
cctacattggatactactgctgcgg

SEQ ID NO: 41005 - DNA, 24 bp, Homo sapiens
aatcctcagttgacctgtctgcgg

SEQ ID NO: 41006 - DNA, 24 bp, Homo sapiens
gcccatgctcgtctcaaactcctg

SEQ ID NO: 41007 - DNA, 24 bp, Homo sapiens
gtgatctgcccacctcagcctctc

SEQ ID NO: 41008 - DNA, 24 bp, Homo sapiens
ctactccatcatctttattccaaa

SEQ ID NO: 41009 - DNA, 24 bp, Homo sapiens
aggtggtgctggccttggagaaat

SEQ ID NO: 41010 - DNA, 24 bp, Homo sapiens
gaggtggtgctggccttggagaaa

SEQ ID NO: 41011 - DNA, 24 bp, Homo sapiens
ggaggtggtgctggccttggagaa

SEQ ID NO: 41012 - DNA, 24 bp, Homo sapiens
tggtggaattgatgctaggatgga

SEQ ID NO: 41013 - DNA, 24 bp, Homo sapiens
actccaaactcaaccatctccaga

SEQ ID NO: 41014 - DNA, 24 bp, Homo sapiens
ctgctgcctgccaccaccatgtct

SEQ ID NO: 41015 - DNA, 23 bp, Homo sapiens
ctgcatctgagcctgtgatacgc

SEQ ID NO: 41016 - DNA, 25 bp, Homo sapiens
ggacttgaaggagcagccaggtaac

SEQ ID NO: 41017 - DNA, 23 bp, Homo sapiens
tcggctggtcaagaggatttccc

SEQ ID NO: 41018 - DNA, 24 bp, Homo sapiens
tatttatccagagaactctcaaaa

SEQ ID NO: 41019 - DNA, 24 bp, Homo sapiens
ttatttatccagagaactctcaaa

SEQ ID NO: 41020 - DNA, 24 bp, Homo sapiens
cttatttatccagagaactctcaa

SEQ ID NO: 41021 - DNA, 24 bp, Homo sapiens
aaaacaaaaatgtaagtaggcccc

SEQ ID NO: 41022 - DNA, 24 bp, Homo sapiens
aaaaacaaaaatgtaagtaggccc

SEQ ID NO: 41023 - DNA, 24 bp, Homo sapiens
gaaaaacaaaaatgtaagtaggcc

SEQ ID NO: 41024 - DNA, 23 bp, Homo sapiens
cgaggaaatggcaggcgacatca

SEQ ID NO: 41025 - DNA, 24 bp, Homo sapiens
aatctcacggacacagacctaatt

SEQ ID NO: 41026 - DNA, 25 bp, Homo sapiens
agatgaatgcacagccaggattgaa

SEQ ID NO: 41027 - DNA, 25 bp, Homo sapiens
gaaggtggtgagcatgtggagaagg

SEQ ID NO: 41028 - DNA, 23 bp, Homo sapiens
aagtcctggcagacaatgtggcg

SEQ ID NO: 41029 - DNA, 23 bp, Homo sapiens
ctgttacagcatagcggtcaggc

SEQ ID NO: 41030 - DNA, 25 bp, Homo sapiens
gcctgctgtccttcttctacttcat

SEQ ID NO: 41031 - DNA, 25 bp, Homo sapiens
actggatctgttctggactggagca

SEQ ID NO: 41032 - DNA, 25 bp, Homo sapiens
acagcataacaatgaaggacgagga

SEQ ID NO: 41033 - DNA, 24 bp, Homo sapiens
gcacatcaactcggaggaggacca

SEQ ID NO: 41034 - DNA, 23 bp, Homo sapiens
ttgcagatgcggccccagcggcg

SEQ ID NO: 41035 - DNA, 23 bp, Homo sapiens
gcagcagccgcagcagcagaccc

SEQ ID NO: 41036 - DNA, 24 bp, Homo sapiens
gaaatttcatgagttggatctgta

SEQ ID NO: 41037 - DNA, 24 bp, Homo sapiens
agaaatttcatgagttggatctgt

SEQ ID NO: 41038 - DNA, 24 bp, Homo sapiens
aagaaatttcatgagttggatctg

SEQ ID NO: 41039 - DNA, 24 bp, Homo sapiens
tgaaaagaaaggtaagtagaataa

SEQ ID NO: 41040 - DNA, 24 bp, Homo sapiens
gtgaaaagaaaggtaagtagaata

SEQ ID NO: 41041 - DNA, 24 bp, Homo sapiens
ggtgaaaagaaaggtaagtagaat

SEQ ID NO: 41042 - DNA, 24 bp, Homo sapiens
aggctgtttcttctgtggcttcaa

SEQ ID NO: 41043 - DNA, 24 bp, Homo sapiens
tttgcttgcctggtgcctggtttc

SEQ ID NO: 41044 - DNA, 24 bp, Homo sapiens
gcacactggagacactcatcaatc

SEQ ID NO: 41045 - DNA, 24 bp, Homo sapiens
tgagtgcagtaaaatcaaatcaga

SEQ ID NO: 41046 - DNA, 24 bp, Homo sapiens
ctgagtgcagtaaaatcaaatcag

SEQ ID NO: 41047 - DNA, 24 bp, Homo sapiens
cctgagtgcagtaaaatcaaatca

SEQ ID NO: 41048 - DNA, 24 bp, Homo sapiens
tacacgaagaactttatgaaaact

SEQ ID NO: 41049 - DNA, 24 bp, Homo sapiens
ctacacgaagaactttatgaaaac

SEQ ID NO: 41050 - DNA, 24 bp, Homo sapiens
tctacacgaagaactttatgaaaa

SEQ ID NO: 41051 - DNA, 25 bp, Homo sapiens
gtccaacaaccgcttctatccaccg

SEQ ID NO: 41052 - DNA, 23 bp, Homo sapiens
gccacttccagcccttccttccc

SEQ ID NO: 41053 - DNA, 23 bp, Homo sapiens
ggacagccgccgcctcaccaagt

SEQ ID NO: 41054 - DNA, 24 bp, Homo sapiens
acaacaaaacacattgagaactga

SEQ ID NO: 41055 - DNA, 24 bp, Homo sapiens
aacaacaaaacacattgagaactg

SEQ ID NO: 41056 - DNA, 24 bp, Homo sapiens
caacaacaaaacacattgagaact

SEQ ID NO: 41057 - DNA, 24 bp, Homo sapiens
tatttgttcagccctgttacagaa

SEQ ID NO: 41058 - DNA, 24 bp, Homo sapiens
ctatttgttcagccctgttacaga

SEQ ID NO: 41059 - DNA, 24 bp, Homo sapiens
gctatttgttcagccctgttacag

SEQ ID NO: 41060 - DNA, 24 bp, Homo sapiens
tagccacacagataatgtctccta

SEQ ID NO: 41061 - DNA, 24 bp, Homo sapiens
atagccacacagataatgtctcct

SEQ ID NO: 41062 - DNA, 24 bp, Homo sapiens
aatagccacacagataatgtctcc

SEQ ID NO: 41063 - DNA, 24 bp, Homo sapiens
gggctgctgtggctgggcctcacc

SEQ ID NO: 41064 - DNA, 24 bp, Homo sapiens
agggctgctgtggctgggcctcac

SEQ ID NO: 41065 - DNA, 24 bp, Homo sapiens
tagggctgctgtggctgggcctca

SEQ ID NO: 41066 - DNA, 23 bp, Homo sapiens
ggtctcttggttcgtcctgctgc

SEQ ID NO: 41067 - DNA, 25 bp, Homo sapiens
accatcttccatgtaccgttcgtga

SEQ ID NO: 41068 - DNA, 25 bp, Homo sapiens
gttcaagcaatcctcccaccacctc

SEQ ID NO: 41069 - DNA, 23 bp, Homo sapiens
tgctgcgggagtgtgtgaagttg

SEQ ID NO: 41070 - DNA, 23 bp, Homo sapiens
gctggctagaggaagcagagcac

SEQ ID NO: 41071 - DNA, 24 bp, Homo sapiens
gccaccctgaagtccaagcaagat

SEQ ID NO: 41072 - DNA, 24 bp, Homo sapiens
ttctttaacaggtgtgcattgaga

SEQ ID NO: 41073 - DNA, 24 bp, Homo sapiens
tttctttaacaggtgtgcattgag

SEQ ID NO: 41074 - DNA, 24 bp, Homo sapiens
atttctttaacaggtgtgcattga

SEQ ID NO: 41075 - DNA, 24 bp, Homo sapiens
ttataagagtgtgtaccatctata

SEQ ID NO: 41076 - DNA, 24 bp, Homo sapiens
tttataagagtgtgtaccatctat

SEQ ID NO: 41077 - DNA, 24 bp, Homo sapiens
atttataagagtgtgtaccatcta

SEQ ID NO: 41078 - DNA, 24 bp, Homo sapiens
ggcaccagcaggagaatgtgttcc

SEQ ID NO: 41079 - DNA, 24 bp, Homo sapiens
gtgttgaggacctgcaccgccaag

SEQ ID NO: 41080 - DNA, 24 bp, Homo sapiens
atgatggctaccgcagttctcagt

SEQ ID NO: 41081 - DNA, 24 bp, Homo sapiens
ctctgttgccgaagctggagtgca

SEQ ID NO: 41082 - DNA, 24 bp, Homo sapiens
ttacattccaggtgtaatatttaa

SEQ ID NO: 41083 - DNA, 24 bp, Homo sapiens
attacattccaggtgtaatattta

SEQ ID NO: 41084 - DNA, 24 bp, Homo sapiens
aattacattccaggtgtaatattt

SEQ ID NO: 41085 - DNA, 24 bp, Homo sapiens
ggattcacaaggtatatattttta

SEQ ID NO: 41086 - DNA, 24 bp, Homo sapiens
aggattcacaaggtatatattttt

SEQ ID NO: 41087 - DNA, 24 bp, Homo sapiens
aaggattcacaaggtatatatttt

SEQ ID NO: 41088 - DNA, 25 bp, Homo sapiens
tgctggagttgtcacattctactgc

SEQ ID NO: 41089 - DNA, 25 bp, Homo sapiens
ccaagcagttaggacttcaggaatt

SEQ ID NO: 41090 - DNA, 25 bp, Homo sapiens
gctgtgctgtttgtggtaaagtgaa

SEQ ID NO: 41091 - DNA, 24 bp, Homo sapiens
gatctacccaggtatatttggatt

SEQ ID NO: 41092 - DNA, 24 bp, Homo sapiens
ggatctacccaggtatatttggat

SEQ ID NO: 41093 - DNA, 24 bp, Homo sapiens
tggatctacccaggtatatttgga

SEQ ID NO: 41094 - DNA, 23 bp, Homo sapiens
atgtggctgtggacttcacgcag

SEQ ID NO: 41095 - DNA, 24 bp, Homo sapiens
cagttgaatcctgctcagaagacc

SEQ ID NO: 41096 - DNA, 24 bp, Homo sapiens
gggatgtgatgctggagacctata

SEQ ID NO: 41097 - DNA, 24 bp, Homo sapiens
ccagagtgttgagattacagccgt

SEQ ID NO: 41098 - DNA, 24 bp, Homo sapiens
agtccattgaagacctccctaaag

SEQ ID NO: 41099 - DNA, 24 bp, Homo sapiens
ctggtctcaaacccctgggctcca

SEQ ID NO: 41100 - DNA, 24 bp, Homo sapiens
tgctatctgtggtctgtgcctcct

SEQ ID NO: 41101 - DNA, 24 bp, Homo sapiens
gactctaactcgcatccgcactgt

SEQ ID NO: 41102 - DNA, 24 bp, Homo sapiens
gagcagcctgaaggtaagagccga

SEQ ID NO: 41103 - DNA, 24 bp, Homo sapiens
aactttgacagataatagaatatc

SEQ ID NO: 41104 - DNA, 24 bp, Homo sapiens
taactttgacagataatagaatat

SEQ ID NO: 41105 - DNA, 24 bp, Homo sapiens
ttaactttgacagataatagaata

SEQ ID NO: 41106 - DNA, 24 bp, Homo sapiens
agtatagttcccagacgacagtgt

SEQ ID NO: 41107 - DNA, 24 bp, Homo sapiens
ttgaaccgcctgcccacaccctcc

SEQ ID NO: 41108 - DNA, 24 bp, Homo sapiens
agcgaggagcttcggcactacgag

SEQ ID NO: 41109 - DNA, 24 bp, Homo sapiens
atatacaatctgtaagtatgtttt

SEQ ID NO: 41110 - DNA, 24 bp, Homo sapiens
gatatacaatctgtaagtatgttt

SEQ ID NO: 41111 - DNA, 24 bp, Homo sapiens
agatatacaatctgtaagtatgtt

SEQ ID NO: 41112 - DNA, 24 bp, Homo sapiens
agaatggctactcatcacacgctg

SEQ ID NO: 41113 - DNA, 24 bp, Homo sapiens
gagaagaaggcggcgttgtccatg

SEQ ID NO: 41114 - DNA, 24 bp, Homo sapiens
cctcaacctgacctccaccttcct

SEQ ID NO: 41115 - DNA, 24 bp, Homo sapiens
ggatggtcgcagaagtacagcaca

SEQ ID NO: 41116 - DNA, 23 bp, Homo sapiens
atcctggatgctcgcttgctcgc

SEQ ID NO: 41117 - DNA, 23 bp, Homo sapiens
cagcaccagcaccagcagcacct

SEQ ID NO: 41118 - DNA, 24 bp, Homo sapiens
tgatattttaggaatcgatgacat

SEQ ID NO: 41119 - DNA, 24 bp, Homo sapiens
ttgatattttaggaatcgatgaca

SEQ ID NO: 41120 - DNA, 24 bp, Homo sapiens
tttgatattttaggaatcgatgac

SEQ ID NO: 41121 - DNA, 24 bp, Homo sapiens
ttttaccttaagccatgtattctt

SEQ ID NO: 41122 - DNA, 24 bp, Homo sapiens
tttttaccttaagccatgtattct

SEQ ID NO: 41123 - DNA, 24 bp, Homo sapiens
atttttaccttaagccatgtattc

SEQ ID NO: 41124 - DNA, 24 bp, Homo sapiens
ctcggacggagggacctaccaggg

SEQ ID NO: 41125 - DNA, 24 bp, Homo sapiens
actcggacggagggacctaccagg

SEQ ID NO: 41126 - DNA, 24 bp, Homo sapiens
tactcggacggagggacctaccag

SEQ ID NO: 41127 - DNA, 24 bp, Homo sapiens
ctacagccagaccagccaactcag

SEQ ID NO: 41128 - DNA, 24 bp, Homo sapiens
tgttgaagaactagtgcaggcgtt

SEQ ID NO: 41129 - DNA, 24 bp, Homo sapiens
gaggaaatgtagctgtatgcctgg

SEQ ID NO: 41130 - DNA, 24 bp, Homo sapiens
ttcccaactgcagctttttaatgg

SEQ ID NO: 41131 - DNA, 24 bp, Homo sapiens
tttcccaactgcagctttttaatg

SEQ ID NO: 41132 - DNA, 24 bp, Homo sapiens
ttttcccaactgcagctttttaat

SEQ ID NO: 41133 - DNA, 25 bp, Homo sapiens
agagggtatcattctggtttgtggt

SEQ ID NO: 41134 - DNA, 25 bp, Homo sapiens
aaatcacacccttcctgctgttgag

SEQ ID NO: 41135 - DNA, 25 bp, Homo sapiens
cagccataagaatgaacaagaaccg

SEQ ID NO: 41136 - DNA, 23 bp, Homo sapiens
ctcctacccagagacccagcacg

SEQ ID NO: 41137 - DNA, 25 bp, Homo sapiens
tggtgtgactgattctctgaagagt

SEQ ID NO: 41138 - DNA, 23 bp, Homo sapiens
tctggtggtggcagtgtgagtga

SEQ ID NO: 41139 - DNA, 24 bp, Homo sapiens
gattcgtcccattctcgtcctcat

SEQ ID NO: 41140 - DNA, 23 bp, Homo sapiens
gggtcctccgacgctgggcttcc

SEQ ID NO: 41141 - DNA, 23 bp, Homo sapiens
gacacgtcgggattggcggctgc

SEQ ID NO: 41142 - DNA, 24 bp, Homo sapiens
acgatgccaaggagctaactggcc

SEQ ID NO: 41143 - DNA, 24 bp, Homo sapiens
cacgatgccaaggagctaactggc

SEQ ID NO: 41144 - DNA, 24 bp, Homo sapiens
gcacgatgccaaggagctaactgg

SEQ ID NO: 41145 - DNA, 23 bp, Homo sapiens
accaagccaagatcgtgccactg

SEQ ID NO: 41146 - DNA, 23 bp, Homo sapiens
gtgcctcagcctcccaaagtgtc

SEQ ID NO: 41147 - DNA, 23 bp, Homo sapiens
agcctgggtgatagagtgagact

SEQ ID NO: 41148 - DNA, 23 bp, Homo sapiens
cagggctgggtctgctatgtcac

SEQ ID NO: 41149 - DNA, 24 bp, Homo sapiens
agtgtcttccgacgtggactcctc

SEQ ID NO: 41150 - DNA, 23 bp, Homo sapiens
agcaggagtaccaggctcgggag

SEQ ID NO: 41151 - DNA, 24 bp, Homo sapiens
gcagcctggagcaggaggccgagt

SEQ ID NO: 41152 - DNA, 24 bp, Homo sapiens
ggcagcctggagcaggaggccgag

SEQ ID NO: 41153 - DNA, 24 bp, Homo sapiens
gggcagcctggagcaggaggccga

SEQ ID NO: 41154 - DNA, 24 bp, Homo sapiens
ccagcacccagccgaggccagact

SEQ ID NO: 41155 - DNA, 24 bp, Homo sapiens
cccagcacccagccgaggccagac

SEQ ID NO: 41156 - DNA, 24 bp, Homo sapiens
tcccagcacccagccgaggccaga

SEQ ID NO: 41157 - DNA, 24 bp, Homo sapiens
agagaagttgccaacatctggagc

SEQ ID NO: 41158 - DNA, 25 bp, Homo sapiens
gaagagtctgacagtatgaagtcca

SEQ ID NO: 41159 - DNA, 23 bp, Homo sapiens
ctgatgctgctggaggctgctgt

SEQ ID NO: 41160 - DNA, 24 bp, Homo sapiens
agtgcttgctgctagagatgctgc

SEQ ID NO: 41161 - DNA, 25 bp, Homo sapiens
ggcacagtggctcatgtctataatc

SEQ ID NO: 41162 - DNA, 25 bp, Homo sapiens
ttagtggctctaccatagaagtcat

SEQ ID NO: 41163 - DNA, 25 bp, Homo sapiens
ctgaagcctgtaatcccagcggttt

SEQ ID NO: 41164 - DNA, 23 bp, Homo sapiens
cttgctgctcgagggcacacgac

SEQ ID NO: 41165 - DNA, 23 bp, Homo sapiens
ccaaggcctaagcccaggtgttg

SEQ ID NO: 41166 - DNA, 23 bp, Homo sapiens
gagaccagcctgagcaacacagc

SEQ ID NO: 41167 - DNA, 24 bp, Homo sapiens
tgtaatcccagcggtttaagaggc

SEQ ID NO: 41168 - DNA, 25 bp, Homo sapiens
agctactaactgatcgccggagacc

SEQ ID NO: 41169 - DNA, 24 bp, Homo sapiens
ttgctgggcaggttgtggctcttt

SEQ ID NO: 41170 - DNA, 24 bp, Homo sapiens
tttgctgggcaggttgtggctctt

SEQ ID NO: 41171 - DNA, 24 bp, Homo sapiens
ctttgctgggcaggttgtggctct

SEQ ID NO: 41172 - DNA, 24 bp, Homo sapiens
taaatgataaggaacatgatatag

SEQ ID NO: 41173 - DNA, 24 bp, Homo sapiens
ctaaatgataaggaacatgatata

SEQ ID NO: 41174 - DNA, 24 bp, Homo sapiens
tctaaatgataaggaacatgatat

SEQ ID NO: 41175 - DNA, 24 bp, Homo sapiens
ctaatgttaaggagttgatttatt

SEQ ID NO: 41176 - DNA, 24 bp, Homo sapiens
actaatgttaaggagttgatttat

SEQ ID NO: 41177 - DNA, 24 bp, Homo sapiens
cactaatgttaaggagttgattta

SEQ ID NO: 41178 - DNA, 23 bp, Homo sapiens
agagggcaggcaggaggtcggag

SEQ ID NO: 41179 - DNA, 23 bp, Homo sapiens
ccacgcagcatcctccggcggcc

SEQ ID NO: 41180 - DNA, 25 bp, Homo sapiens
gcggatagagcagaggaagaagatg

SEQ ID NO: 41181 - DNA, 25 bp, Homo sapiens
gttcagtgaccacctcatccagcag

SEQ ID NO: 41182 - DNA, 24 bp, Homo sapiens
gctgccacctccaccttaatgtcc

SEQ ID NO: 41183 - DNA, 23 bp, Homo sapiens
cattccctgtgtggtgtcctcgg

SEQ ID NO: 41184 - DNA, 23 bp, Homo sapiens
tggaggaaggacggacaggtgat

SEQ ID NO: 41185 - DNA, 25 bp, Homo sapiens
cctcaagcacaacggcaactataca

SEQ ID NO: 41186 - DNA, 24 bp, Homo sapiens
cggcctcagcaaaaccagtggccg

SEQ ID NO: 41187 - DNA, 24 bp, Homo sapiens
ccggcctcagcaaaaccagtggcc

SEQ ID NO: 41188 - DNA, 24 bp, Homo sapiens
cccggcctcagcaaaaccagtggc

SEQ ID NO: 41189 - DNA, 24 bp, Homo sapiens
tgacacaaggaagcaatacaggaa

SEQ ID NO: 41190 - DNA, 24 bp, Homo sapiens
cgacactggtcctggtcctagtct

SEQ ID NO: 41191 - DNA, 24 bp, Homo sapiens
tcgtatgcctgcctcactccttca

SEQ ID NO: 41192 - DNA, 24 bp, Homo sapiens
atggaaattgagtgagaagcctta

SEQ ID NO: 41193 - DNA, 24 bp, Homo sapiens
catggaaattgagtgagaagcctt

SEQ ID NO: 41194 - DNA, 24 bp, Homo sapiens
acatggaaattgagtgagaagcct

SEQ ID NO: 41195 - DNA, 24 bp, Homo sapiens
ctgaagataaggtataattaattt

SEQ ID NO: 41196 - DNA, 24 bp, Homo sapiens
tctgaagataaggtataattaatt

SEQ ID NO: 41197 - DNA, 24 bp, Homo sapiens
atctgaagataaggtataattaat

SEQ ID NO: 41198 - DNA, 23 bp, Homo sapiens
acgccgtcaacgccttcaaccag

SEQ ID NO: 41199 - DNA, 23 bp, Homo sapiens
cgccacctctccgcctctgcctc

SEQ ID NO: 41200 - DNA, 23 bp, Homo sapiens
ttcctcatcctgcgaacgggact

SEQ ID NO: 41201 - DNA, 23 bp, Homo sapiens
cgtcatcatctttgccctctccg

SEQ ID NO: 41202 - DNA, 23 bp, Homo sapiens
ccgctcctggatgtatgctgtgt

SEQ ID NO: 41203 - DNA, 23 bp, Homo sapiens
ctgctgctgctgcttggtcactg

SEQ ID NO: 41204 - DNA, 25 bp, Homo sapiens
gctgacctgctcaagtacaacttct

SEQ ID NO: 41205 - DNA, 25 bp, Homo sapiens
tcttcaagaggtgctgtttcatggg

SEQ ID NO: 41206 - DNA, 23 bp, Homo sapiens
gtgcccaccctgaccgccactac

SEQ ID NO: 41207 - DNA, 24 bp, Homo sapiens
tattaccactggaccctctccttc

SEQ ID NO: 41208 - DNA, 24 bp, Homo sapiens
atattaccactggaccctctcctt

SEQ ID NO: 41209 - DNA, 24 bp, Homo sapiens
gatattaccactggaccctctcct

SEQ ID NO: 41210 - DNA, 24 bp, Homo sapiens
tctatcaacaggtgaagagcgatt

SEQ ID NO: 41211 - DNA, 24 bp, Homo sapiens
ttctatcaacaggtgaagagcgat

SEQ ID NO: 41212 - DNA, 24 bp, Homo sapiens
cttctatcaacaggtgaagagcga

SEQ ID NO: 41213 - DNA, 24 bp, Homo sapiens
ttatatttcagaaaagatgttggt

SEQ ID NO: 41214 - DNA, 24 bp, Homo sapiens
tttatatttcagaaaagatgttgg

SEQ ID NO: 41215 - DNA, 24 bp, Homo sapiens
ttttatatttcagaaaagatgttg

SEQ ID NO: 41216 - DNA, 24 bp, Homo sapiens
ggctggtcttgaactcctgacttc

SEQ ID NO: 41217 - DNA, 25 bp, Homo sapiens
cagtgcttggtcttattaaacgctt

SEQ ID NO: 41218 - DNA, 25 bp, Homo sapiens
acctaacttggaaagacacaatagc

SEQ ID NO: 41219 - DNA, 25 bp, Homo sapiens
caactttctgtctcccgaagcctga

SEQ ID NO: 41220 - DNA, 25 bp, Homo sapiens
tcactagaagaaggcggaataataa

SEQ ID NO: 41221 - DNA, 25 bp, Homo sapiens
ctcaagcaatcctccaacctcagcc

SEQ ID NO: 41222 - DNA, 25 bp, Homo sapiens
ccagtagccttccgccttgataagt

SEQ ID NO: 41223 - DNA, 23 bp, Homo sapiens
gtgtgaccgtggtgattgctggc

SEQ ID NO: 41224 - DNA, 23 bp, Homo sapiens
gccctgaagcagccaccaccatg

SEQ ID NO: 41225 - DNA, 23 bp, Homo sapiens
gaagccttcagcttgtcctggca

SEQ ID NO: 41226 - DNA, 23 bp, Homo sapiens
taggccgcactcatggcatgtgg

SEQ ID NO: 41227 - DNA, 24 bp, Homo sapiens
tggcactcccgagcccccgctgct

SEQ ID NO: 41228 - DNA, 24 bp, Homo sapiens
atggcactcccgagcccccgctgc

SEQ ID NO: 41229 - DNA, 24 bp, Homo sapiens
aatggcactcccgagcccccgctg

SEQ ID NO: 41230 - DNA, 24 bp, Homo sapiens
ctccgaacccaagggtggcctcac

SEQ ID NO: 41231 - DNA, 24 bp, Homo sapiens
cccgcctccgccaccgccgcctcc

SEQ ID NO: 41232 - DNA, 24 bp, Homo sapiens
ctgatccagagtggcccccaccag

SEQ ID NO: 41233 - DNA, 24 bp, Homo sapiens
ccgactcctcagcctcagcctccg

SEQ ID NO: 41234 - DNA, 24 bp, Homo sapiens
aaagcaggagacggcggcagtgtg

SEQ ID NO: 41235 - DNA, 24 bp, Homo sapiens
gagagtggcggagagggcatcttc

SEQ ID NO: 41236 - DNA, 24 bp, Homo sapiens
agatcactgaggtaacaaagtgga

SEQ ID NO: 41237 - DNA, 24 bp, Homo sapiens
aagatcactgaggtaacaaagtgg

SEQ ID NO: 41238 - DNA, 24 bp, Homo sapiens
caagatcactgaggtaacaaagtg

SEQ ID NO: 41239 - DNA, 24 bp, Homo sapiens
ttaggaaaccacttttagaaatta

SEQ ID NO: 41240 - DNA, 24 bp, Homo sapiens
cttaggaaaccacttttagaaatt

SEQ ID NO: 41241 - DNA, 24 bp, Homo sapiens
ccttaggaaaccacttttagaaat

SEQ ID NO: 41242 - DNA, 24 bp, Homo sapiens
ttttaaaacagcttttagaaatta

SEQ ID NO: 41243 - DNA, 24 bp, Homo sapiens
gttttaaaacagcttttagaaatt

SEQ ID NO: 41244 - DNA, 24 bp, Homo sapiens
tgttttaaaacagcttttagaaat

SEQ ID NO: 41245 - DNA, 24 bp, Homo sapiens
tttattttcaggtacaaaagttgc

SEQ ID NO: 41246 - DNA, 24 bp, Homo sapiens
ctttattttcaggtacaaaagttg

SEQ ID NO: 41247 - DNA, 24 bp, Homo sapiens
actttattttcaggtacaaaagtt

SEQ ID NO: 41248 - DNA, 24 bp, Homo sapiens
tggaccacaaggtaactactccag

SEQ ID NO: 41249 - DNA, 24 bp, Homo sapiens
atggaccacaaggtaactactcca

SEQ ID NO: 41250 - DNA, 24 bp, Homo sapiens
tatggaccacaaggtaactactcc

SEQ ID NO: 41251 - DNA, 24 bp, Homo sapiens
ctcctgctgctgttgctgccgctg

SEQ ID NO: 41252 - DNA, 24 bp, Homo sapiens
tgcccgctgcccgctgccctcgcc

SEQ ID NO: 41253 - DNA, 24 bp, Homo sapiens
cgacacagcggggaccctccggcc

SEQ ID NO: 41254 - DNA, 24 bp, Homo sapiens
catgttttgttggactattaggtg

SEQ ID NO: 41255 - DNA, 24 bp, Homo sapiens
ccatgttttgttggactattaggt

SEQ ID NO: 41256 - DNA, 24 bp, Homo sapiens
tccatgttttgttggactattagg

SEQ ID NO: 41257 - DNA, 24 bp, Homo sapiens
tccagatgatgacccgggagcacc

SEQ ID NO: 41258 - DNA, 24 bp, Homo sapiens
atccagatgatgacccgggagcac

SEQ ID NO: 41259 - DNA, 24 bp, Homo sapiens
catccagatgatgacccgggagca

SEQ ID NO: 41260 - DNA, 24 bp, Homo sapiens
gcacagtgattgaggtcgctgaat

SEQ ID NO: 41261 - DNA, 25 bp, Homo sapiens
acctgactgaggcattcttgagttg

SEQ ID NO: 41262 - DNA, 23 bp, Homo sapiens
cagtggcacgatcttggctcacc

SEQ ID NO: 41263 - DNA, 24 bp, Homo sapiens
ctaccagcctcgtgagcgtcctgc

SEQ ID NO: 41264 - DNA, 24 bp, Homo sapiens
gctaccagcctcgtgagcgtcctg

SEQ ID NO: 41265 - DNA, 24 bp, Homo sapiens
agctaccagcctcgtgagcgtcct

SEQ ID NO: 41266 - DNA, 24 bp, Homo sapiens
ttcactttcagatatttgctatcc

SEQ ID NO: 41267 - DNA, 24 bp, Homo sapiens
gttcactttcagatatttgctatc

SEQ ID NO: 41268 - DNA, 24 bp, Homo sapiens
tgttcactttcagatatttgctat

SEQ ID NO: 41269 - DNA, 24 bp, Homo sapiens
gggagagctagtcactgcttcaac

SEQ ID NO: 41270 - DNA, 24 bp, Homo sapiens
ggggagagctagtcactgcttcaa

SEQ ID NO: 41271 - DNA, 24 bp, Homo sapiens
cggggagagctagtcactgcttca

SEQ ID NO: 41272 - DNA, 24 bp, Homo sapiens
taattttaaaggattttttcaagg

SEQ ID NO: 41273 - DNA, 24 bp, Homo sapiens
ttaattttaaaggattttttcaag

SEQ ID NO: 41274 - DNA, 24 bp, Homo sapiens
cttaattttaaaggattttttcaa

SEQ ID NO: 41275 - DNA, 24 bp, Homo sapiens
caaacggcaggtttagaaattatg

SEQ ID NO: 41276 - DNA, 24 bp, Homo sapiens
acaaacggcaggtttagaaattat

SEQ ID NO: 41277 - DNA, 24 bp, Homo sapiens
aacaaacggcaggtttagaaatta

SEQ ID NO: 41278 - DNA, 24 bp, Homo sapiens
acgacttgccatcatctccttcca

SEQ ID NO: 41279 - DNA, 25 bp, Homo sapiens
agaagcctatgtctgcctaccttgc

SEQ ID NO: 41280 - DNA, 24 bp, Homo sapiens
gtgtatgctgctcgacttcgttag

SEQ ID NO: 41281 - DNA, 24 bp, Homo sapiens
ctcagcagctagtcggtggaatgg

SEQ ID NO: 41282 - DNA, 23 bp, Homo sapiens
ggcgagtctcctccagcttctag

SEQ ID NO: 41283 - DNA, 25 bp, Homo sapiens
acggaatcagacactgttaagcgga

SEQ ID NO: 41284 - DNA, 25 bp, Homo sapiens
tggttccagtggcttacaatgacaa

SEQ ID NO: 41285 - DNA, 24 bp, Homo sapiens
cagtgcgggtgaggtaggagaaga

SEQ ID NO: 41286 - DNA, 23 bp, Homo sapiens
tcatcggcaacacctgacaaggc

SEQ ID NO: 41287 - DNA, 25 bp, Homo sapiens
atattaccacggcattagtggagcc

SEQ ID NO: 41288 - DNA, 23 bp, Homo sapiens
gccacgaccccctgcatcaccgt

SEQ ID NO: 41289 - DNA, 24 bp, Homo sapiens
acacggggcaggaagcctgccttc

SEQ ID NO: 41290 - DNA, 24 bp, Homo sapiens
cacacggggcaggaagcctgcctt

SEQ ID NO: 41291 - DNA, 24 bp, Homo sapiens
tcacacggggcaggaagcctgcct

SEQ ID NO: 41292 - DNA, 24 bp, Homo sapiens
tgaaggtgcaggacatccctacgg

SEQ ID NO: 41293 - DNA, 24 bp, Homo sapiens
atgaaggtgcaggacatccctacg

SEQ ID NO: 41294 - DNA, 24 bp, Homo sapiens
gatgaaggtgcaggacatccctac

SEQ ID NO: 41295 - DNA, 25 bp, Homo sapiens
tcattctcgccgtgatcgtcaacag

SEQ ID NO: 41296 - DNA, 23 bp, Homo sapiens
cctcattgccatctgcctggagc

SEQ ID NO: 41297 - DNA, 23 bp, Homo sapiens
gagaggacggaccactccaccac

SEQ ID NO: 41298 - DNA, 23 bp, Homo sapiens
gctccagcctgaccaacgatgtg

SEQ ID NO: 41299 - DNA, 23 bp, Homo sapiens
ggtcagccgagacttgccttctg

SEQ ID NO: 41300 - DNA, 23 bp, Homo sapiens
gcggacgatgctgctggacacaa

SEQ ID NO: 41301 - DNA, 24 bp, Homo sapiens
tgtagccgacaaggacagcatctg

SEQ ID NO: 41302 - DNA, 23 bp, Homo sapiens
aggactgctcgcttctgctgacg

SEQ ID NO: 41303 - DNA, 23 bp, Homo sapiens
ctgggatggtggtggactgggag

SEQ ID NO: 41304 - DNA, 25 bp, Homo sapiens
gcaacaattacgacctgaccagcct

SEQ ID NO: 41305 - DNA, 23 bp, Homo sapiens
ggaacacctacagccagacagcc

SEQ ID NO: 41306 - DNA, 23 bp, Homo sapiens
gtggtgcggctgctgctggatag

SEQ ID NO: 41307 - DNA, 24 bp, Homo sapiens
cgacatcatcaggctcctcctcca

SEQ ID NO: 41308 - DNA, 23 bp, Homo sapiens
cgacattaaccgccagaccaagt

SEQ ID NO: 41309 - DNA, 23 bp, Homo sapiens
gtggtgcggctgctgctggatag

SEQ ID NO: 41310 - DNA, 23 bp, Homo sapiens
cgacattaaccgccagaccaagt

SEQ ID NO: 41311 - DNA, 23 bp, Homo sapiens
gtggtgcggctgctgctggatag

SEQ ID NO: 41312 - DNA, 23 bp, Homo sapiens
ggaacacctacagccagacagcc

SEQ ID NO: 41313 - DNA, 24 bp, Homo sapiens
taaaaaccaatgtaagtgccagtg

SEQ ID NO: 41314 - DNA, 24 bp, Homo sapiens
gtaaaaaccaatgtaagtgccagt

SEQ ID NO: 41315 - DNA, 24 bp, Homo sapiens
ggtaaaaaccaatgtaagtgccag

SEQ ID NO: 41316 - DNA, 24 bp, Homo sapiens
actcctgggctctagcaatcctcc

SEQ ID NO: 41317 - DNA, 24 bp, Homo sapiens
ttcgctcttattgcacaggctgga

SEQ ID NO: 41318 - DNA, 24 bp, Homo sapiens
aagccgtctgtacgagagttgctg

SEQ ID NO: 41319 - DNA, 24 bp, Homo sapiens
ggttcacagaggtatgcttaacaa

SEQ ID NO: 41320 - DNA, 24 bp, Homo sapiens
tggttcacagaggtatgcttaaca

SEQ ID NO: 41321 - DNA, 24 bp, Homo sapiens
ctggttcacagaggtatgcttaac

SEQ ID NO: 41322 - DNA, 24 bp, Homo sapiens
ggaagtgagagggttctgttagag

SEQ ID NO: 41323 - DNA, 24 bp, Homo sapiens
gggaagtgagagggttctgttaga

SEQ ID NO: 41324 - DNA, 24 bp, Homo sapiens
cgggaagtgagagggttctgttag

SEQ ID NO: 41325 - DNA, 23 bp, Homo sapiens
cagaagcagcagccgcagcacct

SEQ ID NO: 41326 - DNA, 24 bp, Homo sapiens
ccgctcactcaggacaacgctatg

SEQ ID NO: 41327 - DNA, 23 bp, Homo sapiens
cacagccaccatctctccgccag

SEQ ID NO: 41328 - DNA, 24 bp, Homo sapiens
ccactctgcagcgcaggggatgag

SEQ ID NO: 41329 - DNA, 24 bp, Homo sapiens
tccactctgcagcgcaggggatga

SEQ ID NO: 41330 - DNA, 24 bp, Homo sapiens
ctccactctgcagcgcaggggatg

SEQ ID NO: 41331 - DNA, 24 bp, Homo sapiens
tctgaaattcggtgagtaaagttt

SEQ ID NO: 41332 - DNA, 24 bp, Homo sapiens
atctgaaattcggtgagtaaagtt

SEQ ID NO: 41333 - DNA, 24 bp, Homo sapiens
aatctgaaattcggtgagtaaagt

SEQ ID NO: 41334 - DNA, 24 bp, Homo sapiens
ctttacaataggtctgattatttt

SEQ ID NO: 41335 - DNA, 24 bp, Homo sapiens
cctttacaataggtctgattattt

SEQ ID NO: 41336 - DNA, 24 bp, Homo sapiens
tcctttacaataggtctgattatt

SEQ ID NO: 41337 - DNA, 24 bp, Homo sapiens
gtttccattgagtaagtaattaat

SEQ ID NO: 41338 - DNA, 24 bp, Homo sapiens
tgtttccattgagtaagtaattaa

SEQ ID NO: 41339 - DNA, 24 bp, Homo sapiens
ttgtttccattgagtaagtaatta

SEQ ID NO: 41340 - DNA, 24 bp, Homo sapiens
atatctctcaggattcttttgttc

SEQ ID NO: 41341 - DNA, 24 bp, Homo sapiens
tatatctctcaggattcttttgtt

SEQ ID NO: 41342 - DNA, 24 bp, Homo sapiens
ttatatctctcaggattcttttgt

SEQ ID NO: 41343 - DNA, 23 bp, Homo sapiens
ccacacagaggcacaggctggac

SEQ ID NO: 41344 - DNA, 23 bp, Homo sapiens
gtttgtgggccacaagccaggac

SEQ ID NO: 41345 - DNA, 23 bp, Homo sapiens
atgattatgatcatgaacggaac

SEQ ID NO: 41346 - DNA, 24 bp, Homo sapiens
acactttttagaacaaatataaag

SEQ ID NO: 41347 - DNA, 24 bp, Homo sapiens
cacactttttagaacaaatataaa

SEQ ID NO: 41348 - DNA, 24 bp, Homo sapiens
ccacactttttagaacaaatataa

SEQ ID NO: 41349 - DNA, 24 bp, Homo sapiens
gatgaaaaaagttctctgagagaa

SEQ ID NO: 41350 - DNA, 24 bp, Homo sapiens
tgatgaaaaaagttctctgagaga

SEQ ID NO: 41351 - DNA, 24 bp, Homo sapiens
ctgatgaaaaaagttctctgagag

SEQ ID NO: 41352 - DNA, 25 bp, Homo sapiens
tgcccttgaattatcctgaaccacc

SEQ ID NO: 41353 - DNA, 23 bp, Homo sapiens
aaacaagttcagggctcccactg

SEQ ID NO: 41354 - DNA, 25 bp, Homo sapiens
caatgtaataatagaaataaagtgc

SEQ ID NO: 41355 - DNA, 24 bp, Homo sapiens
tttattcagaggtaagtacctact

SEQ ID NO: 41356 - DNA, 24 bp, Homo sapiens
ctttattcagaggtaagtacctac

SEQ ID NO: 41357 - DNA, 24 bp, Homo sapiens
tctttattcagaggtaagtaccta

SEQ ID NO: 41358 - DNA, 24 bp, Homo sapiens
gagggctacagggtctactgttat

SEQ ID NO: 41359 - DNA, 24 bp, Homo sapiens
agagggctacagggtctactgtta

SEQ ID NO: 41360 - DNA, 24 bp, Homo sapiens
aagagggctacagggtctactgtt

SEQ ID NO: 41361 - DNA, 24 bp, Homo sapiens
tattgaagaaggtatgttttagtt

SEQ ID NO: 41362 - DNA, 24 bp, Homo sapiens
atattgaagaaggtatgttttagt

SEQ ID NO: 41363 - DNA, 24 bp, Homo sapiens
tatattgaagaaggtatgttttag

SEQ ID NO: 41364 - DNA, 25 bp, Homo sapiens
agtgtctacatctaccttctgcctt

SEQ ID NO: 41365 - DNA, 25 bp, Homo sapiens
aaaggcaacaacagcaccagcaaat

SEQ ID NO: 41366 - DNA, 25 bp, Homo sapiens
agtgatggtgatggagaagattcct

SEQ ID NO: 41367 - DNA, 24 bp, Homo sapiens
agaccgaaaagaaaatgaaaacac

SEQ ID NO: 41368 - DNA, 24 bp, Homo sapiens
cagaccgaaaagaaaatgaaaaca

SEQ ID NO: 41369 - DNA, 24 bp, Homo sapiens
acagaccgaaaagaaaatgaaaac

SEQ ID NO: 41370 - DNA, 24 bp, Homo sapiens
aaggtttctttttttttccttttt

SEQ ID NO: 41371 - DNA, 24 bp, Homo sapiens
tctccaccacccaacccaaaccat

SEQ ID NO: 41372 - DNA, 24 bp, Homo sapiens
ttcaccctccacttcccgtctcag

SEQ ID NO: 41373 - DNA, 24 bp, Homo sapiens
ccaagaagcagaagaccgacgagg

SEQ ID NO: 41374 - DNA, 24 bp, Homo sapiens
tgatgacaaagagaatcatgaaga

SEQ ID NO: 41375 - DNA, 24 bp, Homo sapiens
atgatgacaaagagaatcatgaag

SEQ ID NO: 41376 - DNA, 24 bp, Homo sapiens
catgatgacaaagagaatcatgaa

SEQ ID NO: 41377 - DNA, 23 bp, Homo sapiens
gcagtgggtggtcagcagcagtg

SEQ ID NO: 41378 - DNA, 23 bp, Homo sapiens
cagcacgcctggttcttcttcca

SEQ ID NO: 41379 - DNA, 23 bp, Homo sapiens
cctggacgacatcactgccttgg

SEQ ID NO: 41380 - DNA, 25 bp, Homo sapiens
gcggtggagatgtatattgaggact

SEQ ID NO: 41381 - DNA, 23 bp, Homo sapiens
tcaccacagacacacagcgggag

SEQ ID NO: 41382 - DNA, 24 bp, Homo sapiens
aggatgcttctggagacgagaggt

SEQ ID NO: 41383 - DNA, 23 bp, Homo sapiens
tgatgacttggagctgctgctgc

SEQ ID NO: 41384 - DNA, 25 bp, Homo sapiens
actttgaggatgtacttctgagccg

SEQ ID NO: 41385 - DNA, 23 bp, Homo sapiens
ggtcccactgactgaagttgtcg

SEQ ID NO: 41386 - DNA, 23 bp, Homo sapiens
cgtgtgtgctgtgggtgctgaaa

SEQ ID NO: 41387 - DNA, 24 bp, Homo sapiens
cgtctgttggacttgctgtacctt

SEQ ID NO: 41388 - DNA, 23 bp, Homo sapiens
gccctctctgctgagtcaagccg

SEQ ID NO: 41389 - DNA, 25 bp, Homo sapiens
cggtcattgagaaggttcaggttgc

SEQ ID NO: 41390 - DNA, 24 bp, Homo sapiens
gctccctcttcctcatcgccagta

SEQ ID NO: 41391 - DNA, 23 bp, Homo sapiens
aaaggcaggaggcaggaccaacc

SEQ ID NO: 41392 - DNA, 23 bp, Homo sapiens
tccgccaagaccgacctgatgtt

SEQ ID NO: 41393 - DNA, 23 bp, Homo sapiens
ccaccaccacaaccagaattact

SEQ ID NO: 41394 - DNA, 23 bp, Homo sapiens
ccaggtgccgatagaggagtccg

SEQ ID NO: 41395 - DNA, 24 bp, Homo sapiens
tgaagaaaatggttagtattgtct

SEQ ID NO: 41396 - DNA, 24 bp, Homo sapiens
ctgaagaaaatggttagtattgtc

SEQ ID NO: 41397 - DNA, 24 bp, Homo sapiens
actgaagaaaatggttagtattgt

SEQ ID NO: 41398 - DNA, 24 bp, Homo sapiens
ttctatttcaggttatggactata

SEQ ID NO: 41399 - DNA, 24 bp, Homo sapiens
tttctatttcaggttatggactat

SEQ ID NO: 41400 - DNA, 24 bp, Homo sapiens
ttttctatttcaggttatggacta

SEQ ID NO: 41401 - DNA, 23 bp, Homo sapiens
ggctacctttcctccatttctgc

SEQ ID NO: 41402 - DNA, 24 bp, Homo sapiens
gtactttgccctacacgatgatat

SEQ ID NO: 41403 - DNA, 25 bp, Homo sapiens
tgtttgctaccttttctcaatgatg

SEQ ID NO: 41404 - DNA, 24 bp, Homo sapiens
tctattcacagggcttcattattt

SEQ ID NO: 41405 - DNA, 24 bp, Homo sapiens
ttctattcacagggcttcattatt

SEQ ID NO: 41406 - DNA, 24 bp, Homo sapiens
attctattcacagggcttcattat

SEQ ID NO: 41407 - DNA, 24 bp, Homo sapiens
gaaaagcagaggtgctgttatcag

SEQ ID NO: 41408 - DNA, 24 bp, Homo sapiens
tgaaaagcagaggtgctgttatca

SEQ ID NO: 41409 - DNA, 24 bp, Homo sapiens
ttgaaaagcagaggtgctgttatc

SEQ ID NO: 41410 - DNA, 25 bp, Homo sapiens
cttcaagatgagcgacctggactcc

SEQ ID NO: 41411 - DNA, 23 bp, Homo sapiens
gacctgctgctgggcgacccgtc

SEQ ID NO: 41412 - DNA, 23 bp, Homo sapiens
ctgcccttgccgccgcgctaccg

SEQ ID NO: 41413 - DNA, 23 bp, Homo sapiens
gtggacaacctggacagcctgct

SEQ ID NO: 41414 - DNA, 23 bp, Homo sapiens
tggtggtggtggacaaggagagc

SEQ ID NO: 41415 - DNA, 23 bp, Homo sapiens
cgaggaggactacatggcggacg

SEQ ID NO: 41416 - DNA, 24 bp, Homo sapiens
aatcattcacttcacgtcaccaaa

SEQ ID NO: 41417 - DNA, 24 bp, Homo sapiens
taatcattcacttcacgtcaccaa

SEQ ID NO: 41418 - DNA, 24 bp, Homo sapiens
gtaatcattcacttcacgtcacca

SEQ ID NO: 41419 - DNA, 24 bp, Homo sapiens
atactaatcgggtaggagacacca

SEQ ID NO: 41420 - DNA, 24 bp, Homo sapiens
catactaatcgggtaggagacacc

SEQ ID NO: 41421 - DNA, 24 bp, Homo sapiens
tcatactaatcgggtaggagacac

SEQ ID NO: 41422 - DNA, 24 bp, Homo sapiens
atactaatcggaaatggcgagatt

SEQ ID NO: 41423 - DNA, 24 bp, Homo sapiens
catactaatcggaaatggcgagat

SEQ ID NO: 41424 - DNA, 24 bp, Homo sapiens
tcatactaatcggaaatggcgaga

SEQ ID NO: 41425 - DNA, 23 bp, Homo sapiens
caccgagggcttgtctggcatct

SEQ ID NO: 41426 - DNA, 23 bp, Homo sapiens
tcttcagacgaggtgacgggtgc

SEQ ID NO: 41427 - DNA, 24 bp, Homo sapiens
ggcaggactctactggaactcacc

SEQ ID NO: 41428 - DNA, 24 bp, Homo sapiens
gagtcaaaaagttcaatgttaaaa

SEQ ID NO: 41429 - DNA, 24 bp, Homo sapiens
ggagtcaaaaagttcaatgttaaa

SEQ ID NO: 41430 - DNA, 24 bp, Homo sapiens
aggagtcaaaaagttcaatgttaa

SEQ ID NO: 41431 - DNA, 24 bp, Homo sapiens
gcattgtaaagcaaaagctattgt

SEQ ID NO: 41432 - DNA, 24 bp, Homo sapiens
cgcattgtaaagcaaaagctattg

SEQ ID NO: 41433 - DNA, 24 bp, Homo sapiens
ccgcattgtaaagcaaaagctatt

SEQ ID NO: 41434 - DNA, 25 bp, Homo sapiens
tgctactgaggagtcgtcttcatct

SEQ ID NO: 41435 - DNA, 23 bp, Homo sapiens
tcctggttccctgagcgtgatga

SEQ ID NO: 41436 - DNA, 23 bp, Homo sapiens
tggaggagactgctgggaaaggg

SEQ ID NO: 41437 - DNA, 24 bp, Homo sapiens
gactactgcagaccagtcttttga

SEQ ID NO: 41438 - DNA, 24 bp, Homo sapiens
tgactactgcagaccagtcttttg

SEQ ID NO: 41439 - DNA, 24 bp, Homo sapiens
ttgactactgcagaccagtctttt

SEQ ID NO: 41440 - DNA, 23 bp, Homo sapiens
catggtgcgaggctgggagccgc

SEQ ID NO: 41441 - DNA, 23 bp, Homo sapiens
ccctgccctctcccccacttccc

SEQ ID NO: 41442 - DNA, 23 bp, Homo sapiens
ggcagcaaccccactcccactcg

SEQ ID NO: 41443 - DNA, 25 bp, Homo sapiens
gagccaggatttgaacccagcagat

SEQ ID NO: 41444 - DNA, 24 bp, Homo sapiens
cggagatgaaccagtttagggacc

SEQ ID NO: 41445 - DNA, 25 bp, Homo sapiens
aatgaagtgtcgatccagttgtgct

SEQ ID NO: 41446 - DNA, 24 bp, Homo sapiens
cccagcagcagcagcaaatccaag

SEQ ID NO: 41447 - DNA, 24 bp, Homo sapiens
ggactgtgccgtcttcctgtcagc

SEQ ID NO: 41448 - DNA, 24 bp, Homo sapiens
ccgcatcgagagcatgtgggagtc

SEQ ID NO: 41449 - DNA, 24 bp, Homo sapiens
accttaaaaaagtaagtaaatata

SEQ ID NO: 41450 - DNA, 24 bp, Homo sapiens
aaccttaaaaaagtaagtaaatat

SEQ ID NO: 41451 - DNA, 24 bp, Homo sapiens
aaaccttaaaaaagtaagtaaata

SEQ ID NO: 41452 - DNA, 24 bp, Homo sapiens
gaggtgtccagccttccatgagat

SEQ ID NO: 41453 - DNA, 24 bp, Homo sapiens
agaggtgtccagccttccatgaga

SEQ ID NO: 41454 - DNA, 24 bp, Homo sapiens
aagaggtgtccagccttccatgag

SEQ ID NO: 41455 - DNA, 24 bp, Homo sapiens
ctccaccaccaccacatctccagg

SEQ ID NO: 41456 - DNA, 24 bp, Homo sapiens
cgaggtcttgctcatcaacaacaa

SEQ ID NO: 41457 - DNA, 24 bp, Homo sapiens
accttcctgcacttcgacaagaac

SEQ ID NO: 41458 - DNA, 24 bp, Homo sapiens
gagcggcggcggtggcggcgcgag

SEQ ID NO: 41459 - DNA, 24 bp, Homo sapiens
gcggggcgggtcgcgctggtcccc

SEQ ID NO: 41460 - DNA, 24 bp, Homo sapiens
gctcaagcgatcctcctgccttgg

SEQ ID NO: 41461 - DNA, 24 bp, Homo sapiens
tcacagttcactgcaaccttgact

SEQ ID NO: 41462 - DNA, 24 bp, Homo sapiens
tcagggatttcctcagacagggtc

SEQ ID NO: 41463 - DNA, 24 bp, Homo sapiens
ttaccagaaaggtaacattgctaa

SEQ ID NO: 41464 - DNA, 24 bp, Homo sapiens
cttaccagaaaggtaacattgcta

SEQ ID NO: 41465 - DNA, 24 bp, Homo sapiens
tcttaccagaaaggtaacattgct

SEQ ID NO: 41466 - DNA, 24 bp, Homo sapiens
ttgttttctagtataaaacaagca

SEQ ID NO: 41467 - DNA, 24 bp, Homo sapiens
tttgttttctagtataaaacaagc

SEQ ID NO: 41468 - DNA, 24 bp, Homo sapiens
ttttgttttctagtataaaacaag

SEQ ID NO: 41469 - DNA, 24 bp, Homo sapiens
aaaacaaccaggtaatatgctggc

SEQ ID NO: 41470 - DNA, 24 bp, Homo sapiens
aaaaacaaccaggtaatatgctgg

SEQ ID NO: 41471 - DNA, 24 bp, Homo sapiens
caaaaacaaccaggtaatatgctg

SEQ ID NO: 41472 - DNA, 25 bp, Homo sapiens
accaaatccttctgtcctcccaccc

SEQ ID NO: 41473 - DNA, 25 bp, Homo sapiens
tcctccctttcaatccctactccca

SEQ ID NO: 41474 - DNA, 24 bp, Homo sapiens
cctcaggtgatccatctgcctcgg

SEQ ID NO: 41475 - DNA, 24 bp, Homo sapiens
ttatcttttaggattttgaattat

SEQ ID NO: 41476 - DNA, 24 bp, Homo sapiens
tttatcttttaggattttgaatta

SEQ ID NO: 41477 - DNA, 24 bp, Homo sapiens
ttttatcttttaggattttgaatt

SEQ ID NO: 41478 - DNA, 23 bp, Homo sapiens
cggagcggcggcgaagtttgaac

SEQ ID NO: 41479 - DNA, 23 bp, Homo sapiens
gcgggatcagcgtcctccagccg

SEQ ID NO: 41480 - DNA, 23 bp, Homo sapiens
ccgcccattgttgagcgcgttgg

SEQ ID NO: 41481 - DNA, 23 bp, Homo sapiens
attggtgttggaggctgctggtt

SEQ ID NO: 41482 - DNA, 23 bp, Homo sapiens
ggaggaggcttgtcggctgagag

SEQ ID NO: 41483 - DNA, 25 bp, Homo sapiens
gggagggagctgaatgtgaattgag

SEQ ID NO: 41484 - DNA, 24 bp, Homo sapiens
ctaaacctcgccactactgttttc

SEQ ID NO: 41485 - DNA, 24 bp, Homo sapiens
cctaaacctcgccactactgtttt

SEQ ID NO: 41486 - DNA, 24 bp, Homo sapiens
gcctaaacctcgccactactgttt

SEQ ID NO: 41487 - DNA, 24 bp, Homo sapiens
gcaagtcaagtctcaagatggtat

SEQ ID NO: 41488 - DNA, 24 bp, Homo sapiens
tgctgatctctggaatactttgga

SEQ ID NO: 41489 - DNA, 24 bp, Homo sapiens
catcaaaagccaactgcagagcca

SEQ ID NO: 41490 - DNA, 24 bp, Homo sapiens
actcaaaaaatcagtgcttctact

SEQ ID NO: 41491 - DNA, 24 bp, Homo sapiens
tactcaaaaaatcagtgcttctac

SEQ ID NO: 41492 - DNA, 24 bp, Homo sapiens
ctactcaaaaaatcagtgcttcta

SEQ ID NO: 41493 - DNA, 24 bp, Homo sapiens
aatatttcaagcaagacagtgata

SEQ ID NO: 41494 - DNA, 24 bp, Homo sapiens
gaatatttcaagcaagacagtgat

SEQ ID NO: 41495 - DNA, 24 bp, Homo sapiens
agaatatttcaagcaagacagtga

SEQ ID NO: 41496 - DNA, 24 bp, Homo sapiens
catcactgcaggtcaagtttaatg

SEQ ID NO: 41497 - DNA, 24 bp, Homo sapiens
tcatcactgcaggtcaagtttaat

SEQ ID NO: 41498 - DNA, 24 bp, Homo sapiens
ttcatcactgcaggtcaagtttaa

SEQ ID NO: 41499 - DNA, 25 bp, Homo sapiens
ggttgtttcagcctgtgcagtatgg

SEQ ID NO: 41500 - DNA, 23 bp, Homo sapiens
cagcccgaccagcagcagcaaag

SEQ ID NO: 41501 - DNA, 23 bp, Homo sapiens
cgtcacgaggcagagttgctgtc

SEQ ID NO: 41502 - DNA, 23 bp, Homo sapiens
gccaccgctgccacaaccacagg

SEQ ID NO: 41503 - DNA, 23 bp, Homo sapiens
cacagccccagacccagccacag

SEQ ID NO: 41504 - DNA, 23 bp, Homo sapiens
gaaggcgcagcccgcaatcacga

SEQ ID NO: 41505 - DNA, 24 bp, Homo sapiens
ggtgttcgagcggtcacttctgtg

SEQ ID NO: 41506 - DNA, 23 bp, Homo sapiens
gtcccaagccacaggagttcagc

SEQ ID NO: 41507 - DNA, 23 bp, Homo sapiens
agcagcagcagcagcaacaacag

SEQ ID NO: 41508 - DNA, 24 bp, Homo sapiens
atcaaacctcttggaatcaactat

SEQ ID NO: 41509 - DNA, 24 bp, Homo sapiens
aatcaaacctcttggaatcaacta

SEQ ID NO: 41510 - DNA, 24 bp, Homo sapiens
caatcaaacctcttggaatcaact

SEQ ID NO: 41511 - DNA, 24 bp, Homo sapiens
tggaccgcagcctctcccgccaga

SEQ ID NO: 41512 - DNA, 24 bp, Homo sapiens
atggaccgcagcctctcccgccag

SEQ ID NO: 41513 - DNA, 24 bp, Homo sapiens
catggaccgcagcctctcccgcca

SEQ ID NO: 41514 - DNA, 24 bp, Homo sapiens
ccgcagggagcaaggatgacagtg

SEQ ID NO: 41515 - DNA, 24 bp, Homo sapiens
tgccagccagccacggagaaccag

SEQ ID NO: 41516 - DNA, 24 bp, Homo sapiens
ggagtccacaggcatttaccgagt

SEQ ID NO: 41517 - DNA, 24 bp, Homo sapiens
ccttaataaagttacatgctatgg

SEQ ID NO: 41518 - DNA, 24 bp, Homo sapiens
accttaataaagttacatgctatg

SEQ ID NO: 41519 - DNA, 24 bp, Homo sapiens
taccttaataaagttacatgctat

SEQ ID NO: 41520 - DNA, 24 bp, Homo sapiens
gcctctgaaccagcagtgacttat

SEQ ID NO: 41521 - DNA, 24 bp, Homo sapiens
tgcgtcttcctatctccgaaaccc

SEQ ID NO: 41522 - DNA, 24 bp, Homo sapiens
cacggcacaccacactgaagttct

SEQ ID NO: 41523 - DNA, 24 bp, Homo sapiens
cagcagcagcggcaactggaaatc

SEQ ID NO: 41524 - DNA, 24 bp, Homo sapiens
aagaggccctcagactcacagtgg

SEQ ID NO: 41525 - DNA, 24 bp, Homo sapiens
gagttgacgccctgcgttcccatg

SEQ ID NO: 41526 - DNA, 24 bp, Homo sapiens
gtggtgccgagtgcctgctgcctt

SEQ ID NO: 41527 - DNA, 24 bp, Homo sapiens
cgtggtgccgagtgcctgctgcct

SEQ ID NO: 41528 - DNA, 24 bp, Homo sapiens
ccgtggtgccgagtgcctgctgcc

SEQ ID NO: 41529 - DNA, 23 bp, Homo sapiens
actgagagtgctgacaaggctgc

SEQ ID NO: 41530 - DNA, 23 bp, Homo sapiens
cagagtgtggagcaggtggtgtt

SEQ ID NO: 41531 - DNA, 23 bp, Homo sapiens
aggtggctggtgtctcggatcaa

SEQ ID NO: 41532 - DNA, 25 bp, Homo sapiens
gctacgctaagatgctggcactgag

SEQ ID NO: 41533 - DNA, 25 bp, Homo sapiens
ccagaaagcagaaagggtgaagcaa

SEQ ID NO: 41534 - DNA, 23 bp, Homo sapiens
ctgcctgccctatgccatcacca

SEQ ID NO: 41535 - DNA, 23 bp, Homo sapiens
gccctgctgccctcttactgcca

SEQ ID NO: 41536 - DNA, 23 bp, Homo sapiens
aaggcgtctctagcgtggaggtc

SEQ ID NO: 41537 - DNA, 23 bp, Homo sapiens
cgacgaccctgtcttcatccacc

SEQ ID NO: 41538 - DNA, 24 bp, Homo sapiens
acaacaccaagagaaacagaaact

SEQ ID NO: 41539 - DNA, 24 bp, Homo sapiens
tacaacaccaagagaaacagaaac

SEQ ID NO: 41540 - DNA, 24 bp, Homo sapiens
ctacaacaccaagagaaacagaaa

SEQ ID NO: 41541 - DNA, 24 bp, Homo sapiens
acgtgtaacaggtattttctttca

SEQ ID NO: 41542 - DNA, 24 bp, Homo sapiens
cacgtgtaacaggtattttctttc

SEQ ID NO: 41543 - DNA, 24 bp, Homo sapiens
tcacgtgtaacaggtattttcttt

SEQ ID NO: 41544 - DNA, 24 bp, Homo sapiens
tccaggctgaggtgcagctggtcc

SEQ ID NO: 41545 - DNA, 24 bp, Homo sapiens
ttccaggctgaggtgcagctggtc

SEQ ID NO: 41546 - DNA, 24 bp, Homo sapiens
cttccaggctgaggtgcagctggt

SEQ ID NO: 41547 - DNA, 24 bp, Homo sapiens
acaccatccaagccctgctggagc

SEQ ID NO: 41548 - DNA, 24 bp, Homo sapiens
tacaccatccaagccctgctggag

SEQ ID NO: 41549 - DNA, 24 bp, Homo sapiens
ctacaccatccaagccctgctgga

SEQ ID NO: 41550 - DNA, 24 bp, Homo sapiens
attattttcagattgttttcagag

SEQ ID NO: 41551 - DNA, 24 bp, Homo sapiens
gattattttcagattgttttcaga

SEQ ID NO: 41552 - DNA, 24 bp, Homo sapiens
tgattattttcagattgttttcag

SEQ ID NO: 41553 - DNA, 24 bp, Homo sapiens
agaaaagaaaggacaaaaatgccc

SEQ ID NO: 41554 - DNA, 24 bp, Homo sapiens
gagaaaagaaaggacaaaaatgcc

SEQ ID NO: 41555 - DNA, 24 bp, Homo sapiens
ggagaaaagaaaggacaaaaatgc

SEQ ID NO: 41556 - DNA, 24 bp, Homo sapiens
ctgtgtacctgaaatatttagcat

SEQ ID NO: 41557 - DNA, 24 bp, Homo sapiens
gctgtgtacctgaaatatttagca

SEQ ID NO: 41558 - DNA, 24 bp, Homo sapiens
tgctgtgtacctgaaatatttagc

SEQ ID NO: 41559 - DNA, 24 bp, Homo sapiens
tcatctgccagcccctccagagcg

SEQ ID NO: 41560 - DNA, 24 bp, Homo sapiens
ctcatctgccagcccctccagagc

SEQ ID NO: 41561 - DNA, 24 bp, Homo sapiens
cctcatctgccagcccctccagag

SEQ ID NO: 41562 - DNA, 23 bp, Homo sapiens
cacacacgacacacgagagcagg

SEQ ID NO: 41563 - DNA, 23 bp, Homo sapiens
cgtcctggcacattgtccacagc

SEQ ID NO: 41564 - DNA, 23 bp, Homo sapiens
agccaccctccctgcccactttc

SEQ ID NO: 41565 - DNA, 23 bp, Homo sapiens
ctgccctgccctgccctgccctg

SEQ ID NO: 41566 - DNA, 23 bp, Homo sapiens
cggaaggccaggccggtgccctg

SEQ ID NO: 41567 - DNA, 23 bp, Homo sapiens
gcccagcgcagcccagccccgcg

SEQ ID NO: 41568 - DNA, 25 bp, Homo sapiens
ggatgatgctgctgctatgtcactg

SEQ ID NO: 41569 - DNA, 24 bp, Homo sapiens
cgcctcatccgctacatacaccag

SEQ ID NO: 41570 - DNA, 23 bp, Homo sapiens
cgcatcgttcgcttcaccaagat

SEQ ID NO: 41571 - DNA, 23 bp, Homo sapiens
ggtcaggcaggcgttctccgagc

SEQ ID NO: 41572 - DNA, 23 bp, Homo sapiens
gagtgggagggtacaggaggcag

SEQ ID NO: 41573 - DNA, 23 bp, Homo sapiens
gcggctgagaaggctgaggcacc

SEQ ID NO: 41574 - DNA, 24 bp, Homo sapiens
cggcctgctgggctctcggctgag

SEQ ID NO: 41575 - DNA, 24 bp, Homo sapiens
gcggcctgctgggctctcggctga

SEQ ID NO: 41576 - DNA, 24 bp, Homo sapiens
cgcggcctgctgggctctcggctg

SEQ ID NO: 41577 - DNA, 24 bp, Homo sapiens
gctgaagctgatggacgacctcga

SEQ ID NO: 41578 - DNA, 24 bp, Homo sapiens
ccgcttgtgtccgcagtcccgatg

SEQ ID NO: 41579 - DNA, 24 bp, Homo sapiens
cagtggcaggaggtggagaaggaa

SEQ ID NO: 41580 - DNA, 24 bp, Homo sapiens
cacaccagcaccaacacacattcg

SEQ ID NO: 41581 - DNA, 24 bp, Homo sapiens
cgtttgacaagtatgcgcccaagc

SEQ ID NO: 41582 - DNA, 24 bp, Homo sapiens
tccccgcagggctgcccccgacgc

SEQ ID NO: 41583 - DNA, 24 bp, Homo sapiens
gcagtcaagtcttcggacctgatt

SEQ ID NO: 41584 - DNA, 24 bp, Homo sapiens
acttgtgggtcattgttggcgtgg

SEQ ID NO: 41585 - DNA, 24 bp, Homo sapiens
agtgctggtggtgatggtgattgt

SEQ ID NO: 41586 - DNA, 24 bp, Homo sapiens
caggacctctgaaggaccacacca

SEQ ID NO: 41587 - DNA, 24 bp, Homo sapiens
gccaacattcagcagcgtcagaag

SEQ ID NO: 41588 - DNA, 24 bp, Homo sapiens
agtgctggtggtgatggtgattgt

SEQ ID NO: 41589 - DNA, 23 bp, Homo sapiens
agatccagtgctactcccctgca

SEQ ID NO: 41590 - DNA, 23 bp, Homo sapiens
agagatggatgggctggtcgtgg

SEQ ID NO: 41591 - DNA, 23 bp, Homo sapiens
agctggcgtcaactgcacctttg

SEQ ID NO: 41592 - DNA, 24 bp, Homo sapiens
tgctagagatgaaggtgtcggtgc

SEQ ID NO: 41593 - DNA, 24 bp, Homo sapiens
ctcttccacaggcgatctccatcc

SEQ ID NO: 41594 - DNA, 24 bp, Homo sapiens
cgtggtggtgatgtttggaaagca

SEQ ID NO: 41595 - DNA, 24 bp, Homo sapiens
ctcgggagcagtatttccagtggc

SEQ ID NO: 41596 - DNA, 23 bp, Homo sapiens
agacactgcgggagaggctcatt

SEQ ID NO: 41597 - DNA, 24 bp, Homo sapiens
gctggaggagattgatggattctt

SEQ ID NO: 41598 - DNA, 24 bp, Homo sapiens
ctttaaacatggtacgtatcttct

SEQ ID NO: 41599 - DNA, 24 bp, Homo sapiens
tctttaaacatggtacgtatcttc

SEQ ID NO: 41600 - DNA, 24 bp, Homo sapiens
gtctttaaacatggtacgtatctt

SEQ ID NO: 41601 - DNA, 23 bp, Homo sapiens
gcacctcagccagccagagacaa

SEQ ID NO: 41602 - DNA, 23 bp, Homo sapiens
agcactacaccgcctatctcagc

SEQ ID NO: 41603 - DNA, 23 bp, Homo sapiens
gtccgccgttacatagcaacacc

SEQ ID NO: 41604 - DNA, 25 bp, Homo sapiens
tctctgctgaaggtgtggacatcgt

SEQ ID NO: 41605 - DNA, 25 bp, Homo sapiens
tgacccacctctttgacagaaatgc

SEQ ID NO: 41606 - DNA, 23 bp, Homo sapiens
ggaagggatgtctgtgctcgtgc

SEQ ID NO: 41607 - DNA, 24 bp, Homo sapiens
aggtaggaaagcttcaaaatctat

SEQ ID NO: 41608 - DNA, 24 bp, Homo sapiens
caggtaggaaagcttcaaaatcta

SEQ ID NO: 41609 - DNA, 24 bp, Homo sapiens
ccaggtaggaaagcttcaaaatct

SEQ ID NO: 41610 - DNA, 24 bp, Homo sapiens
gattcatcatcggcttttaccttt

SEQ ID NO: 41611 - DNA, 24 bp, Homo sapiens
tgattcatcatcggcttttacctt

SEQ ID NO: 41612 - DNA, 24 bp, Homo sapiens
atgattcatcatcggcttttacct

SEQ ID NO: 41613 - DNA, 24 bp, Homo sapiens
taaatttgcagattttggaatcat

SEQ ID NO: 41614 - DNA, 24 bp, Homo sapiens
ttaaatttgcagattttggaatca

SEQ ID NO: 41615 - DNA, 24 bp, Homo sapiens
tttaaatttgcagattttggaatc

SEQ ID NO: 41616 - DNA, 24 bp, Homo sapiens
actcggtgctgctcatcattactg

SEQ ID NO: 41617 - DNA, 23 bp, Homo sapiens
gtggcatcgacggcatcctggag

SEQ ID NO: 41618 - DNA, 25 bp, Homo sapiens
ccactgaatggcaaccaggagaacc

SEQ ID NO: 41619 - DNA, 24 bp, Homo sapiens
tgaatacccgcattacaccacaat

SEQ ID NO: 41620 - DNA, 24 bp, Homo sapiens
gtctgaatttgcctctggatgtgc

SEQ ID NO: 41621 - DNA, 24 bp, Homo sapiens
agacttgggaagcctgacatttct

SEQ ID NO: 41622 - DNA, 24 bp, Homo sapiens
atgccgattgagaaactgtcagga

SEQ ID NO: 41623 - DNA, 24 bp, Homo sapiens
tcttcggagagaggttcaggatgc

SEQ ID NO: 41624 - DNA, 24 bp, Homo sapiens
ttgtcagccaccaccgccagtaac

SEQ ID NO: 41625 - DNA, 24 bp, Homo sapiens
aaaccagcgggagacttatgagcg

SEQ ID NO: 41626 - DNA, 24 bp, Homo sapiens
tacaggcgttgctgaaccagaagg

SEQ ID NO: 41627 - DNA, 24 bp, Homo sapiens
ctcactccactccagccaccatca

SEQ ID NO: 41628 - DNA, 24 bp, Homo sapiens
ctgtgtgtctagctgtgatggaat

SEQ ID NO: 41629 - DNA, 24 bp, Homo sapiens
cctgtgtgtctagctgtgatggaa

SEQ ID NO: 41630 - DNA, 24 bp, Homo sapiens
gcctgtgtgtctagctgtgatgga

SEQ ID NO: 41631 - DNA, 24 bp, Homo sapiens
caaacgacgtgatctcttccctga

SEQ ID NO: 41632 - DNA, 24 bp, Homo sapiens
ccaaacgacgtgatctcttccctg

SEQ ID NO: 41633 - DNA, 24 bp, Homo sapiens
cccaaacgacgtgatctcttccct

SEQ ID NO: 41634 - DNA, 24 bp, Homo sapiens
agccctgagcagccgcagccgtat

SEQ ID NO: 41635 - DNA, 24 bp, Homo sapiens
gagccctgagcagccgcagccgta

SEQ ID NO: 41636 - DNA, 24 bp, Homo sapiens
cgagccctgagcagccgcagccgt

SEQ ID NO: 41637 - DNA, 25 bp, Homo sapiens
aagaccacaggatctgcctacacct

SEQ ID NO: 41638 - DNA, 25 bp, Homo sapiens
cctgatcctggagtacctgattggc

SEQ ID NO: 41639 - DNA, 23 bp, Homo sapiens
tagccaaccacaccatcagccgc

SEQ ID NO: 41640 - DNA, 24 bp, Homo sapiens
acggttgctcacgcctgtaatcac

SEQ ID NO: 41641 - DNA, 24 bp, Homo sapiens
gacgagatggctgctgctgaagaa

SEQ ID NO: 41642 - DNA, 24 bp, Homo sapiens
ccaggaacagtctcgcaggcaatg

SEQ ID NO: 41643 - DNA, 23 bp, Homo sapiens
gcagcagccaccaccatagccaa

SEQ ID NO: 41644 - DNA, 24 bp, Homo sapiens
cgctaccgatcctgctatgactgc

SEQ ID NO: 41645 - DNA, 24 bp, Homo sapiens
agtcatccagctaccactctccag

SEQ ID NO: 41646 - DNA, 24 bp, Homo sapiens
aacccttcatcagaagaggcagca

SEQ ID NO: 41647 - DNA, 24 bp, Homo sapiens
ctaagactcaaggcagtgaaatca

SEQ ID NO: 41648 - DNA, 24 bp, Homo sapiens
cactttgggaggccgaggcaggag

SEQ ID NO: 41649 - DNA, 23 bp, Homo sapiens
cgttgggctgcttggttctgaca

SEQ ID NO: 41650 - DNA, 23 bp, Homo sapiens
gccagagcgaacgtgagtgtgaa

SEQ ID NO: 41651 - DNA, 23 bp, Homo sapiens
aaagcaatggagattggatggat

SEQ ID NO: 41652 - DNA, 24 bp, Homo sapiens
ctccccattagattggatttagcc

SEQ ID NO: 41653 - DNA, 24 bp, Homo sapiens
actccccattagattggatttagc

SEQ ID NO: 41654 - DNA, 24 bp, Homo sapiens
tactccccattagattggatttag

SEQ ID NO: 41655 - DNA, 24 bp, Homo sapiens
tcagccttgatgaatgatgtattt

SEQ ID NO: 41656 - DNA, 24 bp, Homo sapiens
ttcagccttgatgaatgatgtatt

SEQ ID NO: 41657 - DNA, 24 bp, Homo sapiens
attcagccttgatgaatgatgtat

SEQ ID NO: 41658 - DNA, 23 bp, Homo sapiens
tacagcagcaaccacacgcagcc

SEQ ID NO: 41659 - DNA, 25 bp, Homo sapiens
agaagacatcctcattggcggcttg

SEQ ID NO: 41660 - DNA, 25 bp, Homo sapiens
tcaagattgtcaactacactgtgcg

SEQ ID NO: 41661 - DNA, 24 bp, Homo sapiens
tcctttgctggctaaagaaagggt

SEQ ID NO: 41662 - DNA, 24 bp, Homo sapiens
atcctttgctggctaaagaaaggg

SEQ ID NO: 41663 - DNA, 24 bp, Homo sapiens
gatcctttgctggctaaagaaagg

SEQ ID NO: 41664 - DNA, 24 bp, Homo sapiens
gcagtaacaggagctgattatatt

SEQ ID NO: 41665 - DNA, 24 bp, Homo sapiens
tgcagtaacaggagctgattatat

SEQ ID NO: 41666 - DNA, 24 bp, Homo sapiens
ttgcagtaacaggagctgattata

SEQ ID NO: 41667 - DNA, 24 bp, Homo sapiens
gaattgaagatcatgctaaacact

SEQ ID NO: 41668 - DNA, 24 bp, Homo sapiens
agaattgaagatcatgctaaacac

SEQ ID NO: 41669 - DNA, 24 bp, Homo sapiens
cagaattgaagatcatgctaaaca

SEQ ID NO: 41670 - DNA, 23 bp, Homo sapiens
gtgtggcgaggagctggttgcgg

SEQ ID NO: 41671 - DNA, 23 bp, Homo sapiens
cagacaccgtgcacctggtaggc

SEQ ID NO: 41672 - DNA, 23 bp, Homo sapiens
ctggcagaggctggaagaggcgg

SEQ ID NO: 41673 - DNA, 25 bp, Homo sapiens
aggatgctctgctcttgtggtgtca

SEQ ID NO: 41674 - DNA, 25 bp, Homo sapiens
aagtccaatgccaactacaacctgc

SEQ ID NO: 41675 - DNA, 25 bp, Homo sapiens
tcctgaagatgtgaacatggaggct

SEQ ID NO: 41676 - DNA, 24 bp, Homo sapiens
gtgcagcaccggtggaaccgcatc

SEQ ID NO: 41677 - DNA, 24 bp, Homo sapiens
ggtgcagcaccggtggaaccgcat

SEQ ID NO: 41678 - DNA, 24 bp, Homo sapiens
tggtgcagcaccggtggaaccgca

SEQ ID NO: 41679 - DNA, 24 bp, Homo sapiens
atgcaaagtttttataaagatgat

SEQ ID NO: 41680 - DNA, 24 bp, Homo sapiens
aatgcaaagtttttataaagatga

SEQ ID NO: 41681 - DNA, 24 bp, Homo sapiens
aaatgcaaagtttttataaagatg

SEQ ID NO: 41682 - DNA, 24 bp, Homo sapiens
gaacaaaccaggcacttgtatttc

SEQ ID NO: 41683 - DNA, 24 bp, Homo sapiens
agaacaaaccaggcacttgtattt

SEQ ID NO: 41684 - DNA, 24 bp, Homo sapiens
aagaacaaaccaggcacttgtatt

SEQ ID NO: 41685 - DNA, 23 bp, Homo sapiens
acgctggagtgtggtggtgtgat

SEQ ID NO: 41686 - DNA, 24 bp, Homo sapiens
tctctggattgtcattgcctgctt

SEQ ID NO: 41687 - DNA, 23 bp, Homo sapiens
tgatcctcctgcttcagcctcct

SEQ ID NO: 41688 - DNA, 23 bp, Homo sapiens
gctagatgactgccatgccgacg

SEQ ID NO: 41689 - DNA, 23 bp, Homo sapiens
ccacctcctacaagtgctcctgc

SEQ ID NO: 41690 - DNA, 24 bp, Homo sapiens
gaaggcaggcagtgtgaggacatc

SEQ ID NO: 41691 - DNA, 24 bp, Homo sapiens
gggccatcaaggtcaccgagacca

SEQ ID NO: 41692 - DNA, 24 bp, Homo sapiens
ggggccatcaaggtcaccgagacc

SEQ ID NO: 41693 - DNA, 24 bp, Homo sapiens
gggggccatcaaggtcaccgagac

SEQ ID NO: 41694 - DNA, 24 bp, Homo sapiens
ggagagcgtggcgagagaatgaag

SEQ ID NO: 41695 - DNA, 24 bp, Homo sapiens
ggagaagcatgaggtggcagtgtg

SEQ ID NO: 41696 - DNA, 23 bp, Homo sapiens
ctggctgggtgttggctgtctca

SEQ ID NO: 41697 - DNA, 25 bp, Homo sapiens
ggagtatgctgacttcatggagcgg

SEQ ID NO: 41698 - DNA, 23 bp, Homo sapiens
cctggactggctgctcacagacc

SEQ ID NO: 41699 - DNA, 23 bp, Homo sapiens
ctggctgggtgttggctgtctca

SEQ ID NO: 41700 - DNA, 25 bp, Homo sapiens
gcagcaactatgacaatctggactc

SEQ ID NO: 41701 - DNA, 23 bp, Homo sapiens
ggtgctgctgcctgagtatctgc

SEQ ID NO: 41702 - DNA, 25 bp, Homo sapiens
ttgaagagtcagaagagttccaggc

SEQ ID NO: 41703 - DNA, 23 bp, Homo sapiens
ggtgctgctgcctgagtatctgc

SEQ ID NO: 41704 - DNA, 25 bp, Homo sapiens
gcagcaactatgacaatctggactc

SEQ ID NO: 41705 - DNA, 23 bp, Homo sapiens
gcaccatatccagatagccacgg

SEQ ID NO: 41706 - DNA, 24 bp, Homo sapiens
tggtggaaaaggctgacagctggg

SEQ ID NO: 41707 - DNA, 24 bp, Homo sapiens
gtggtggaaaaggctgacagctgg

SEQ ID NO: 41708 - DNA, 24 bp, Homo sapiens
ggtggtggaaaaggctgacagctg

SEQ ID NO: 41709 - DNA, 24 bp, Homo sapiens
aaggtgttgactgcgatattgacg

SEQ ID NO: 41710 - DNA, 24 bp, Homo sapiens
gatggtgcggtctcagaggtcagg

SEQ ID NO: 41711 - DNA, 24 bp, Homo sapiens
ccagacagaagcacagtaccgatt

SEQ ID NO: 41712 - DNA, 24 bp, Homo sapiens
tatttttctgggtacatcaggaac

SEQ ID NO: 41713 - DNA, 24 bp, Homo sapiens
atatttttctgggtacatcaggaa

SEQ ID NO: 41714 - DNA, 24 bp, Homo sapiens
tatatttttctgggtacatcagga

SEQ ID NO: 41715 - DNA, 24 bp, Homo sapiens
tgaacagtagagtaagtaaaactt

SEQ ID NO: 41716 - DNA, 24 bp, Homo sapiens
atgaacagtagagtaagtaaaact

SEQ ID NO: 41717 - DNA, 24 bp, Homo sapiens
catgaacagtagagtaagtaaaac

SEQ ID NO: 41718 - DNA, 25 bp, Homo sapiens
acctgatggtgccagtgttcattgg

SEQ ID NO: 41719 - DNA, 25 bp, Homo sapiens
cgacatcacctacacgctggaatac

SEQ ID NO: 41720 - DNA, 25 bp, Homo sapiens
acactggacagcctcaaggactaca

SEQ ID NO: 41721 - DNA, 24 bp, Homo sapiens
ggtctattcttgtaagtaataaaa

SEQ ID NO: 41722 - DNA, 24 bp, Homo sapiens
cggtctattcttgtaagtaataaa

SEQ ID NO: 41723 - DNA, 24 bp, Homo sapiens
acggtctattcttgtaagtaataa

SEQ ID NO: 41724 - DNA, 24 bp, Homo sapiens
tacttatccaggtggttcatctgt

SEQ ID NO: 41725 - DNA, 24 bp, Homo sapiens
ttacttatccaggtggttcatctg

SEQ ID NO: 41726 - DNA, 24 bp, Homo sapiens
tttacttatccaggtggttcatct

SEQ ID NO: 41727 - DNA, 24 bp, Homo sapiens
ttttattgtaggccaccaaaatga

SEQ ID NO: 41728 - DNA, 24 bp, Homo sapiens
tttttattgtaggccaccaaaatg

SEQ ID NO: 41729 - DNA, 24 bp, Homo sapiens
atttttattgtaggccaccaaaat

SEQ ID NO: 41730 - DNA, 25 bp, Homo sapiens
cggacataacactaacgtgcaacaa

SEQ ID NO: 41731 - DNA, 23 bp, Homo sapiens
taatccaaggtccgtcgcagcca

SEQ ID NO: 41732 - DNA, 25 bp, Homo sapiens
tccattatgtgaacggagtcagcac

SEQ ID NO: 41733 - DNA, 24 bp, Homo sapiens
cattctccacgaatcttatataca

SEQ ID NO: 41734 - DNA, 24 bp, Homo sapiens
tcattctccacgaatcttatatac

SEQ ID NO: 41735 - DNA, 24 bp, Homo sapiens
ttcattctccacgaatcttatata

SEQ ID NO: 41736 - DNA, 23 bp, Homo sapiens
gtggctgcttctgctgctggttg

SEQ ID NO: 41737 - DNA, 24 bp, Homo sapiens
acaccttctatgacaactgccgcc

SEQ ID NO: 41738 - DNA, 24 bp, Homo sapiens
agggctttaagttgtggctgggtc

SEQ ID NO: 41739 - DNA, 23 bp, Homo sapiens
aggtcatcgtccttcctcctgga

SEQ ID NO: 41740 - DNA, 23 bp, Homo sapiens
caatggaggtggtggtggtggtg

SEQ ID NO: 41741 - DNA, 25 bp, Homo sapiens
ggaggaacttatctggacaggaagg

SEQ ID NO: 41742 - DNA, 24 bp, Homo sapiens
cgtttggatggatttggacaggaa

SEQ ID NO: 41743 - DNA, 24 bp, Homo sapiens
ggaacagaattggaagacaagcgg

SEQ ID NO: 41744 - DNA, 24 bp, Homo sapiens
agactgccctctttcacacggatg

SEQ ID NO: 41745 - DNA, 24 bp, Homo sapiens
catcagagccagccaccactaagc

SEQ ID NO: 41746 - DNA, 24 bp, Homo sapiens
agttccagcatctgtccaaggagt

SEQ ID NO: 41747 - DNA, 24 bp, Homo sapiens
atgattgcctcagtcagcgggtcc

SEQ ID NO: 41748 - DNA, 24 bp, Homo sapiens
gctccagaccagatgccagaatgg

SEQ ID NO: 41749 - DNA, 24 bp, Homo sapiens
tagatgtagtggagaccgaggtgg

SEQ ID NO: 41750 - DNA, 24 bp, Homo sapiens
gtctgtggatcagcagttctcgcc

SEQ ID NO: 41751 - DNA, 24 bp, Homo sapiens
tcctttactaggagcaatatcaat

SEQ ID NO: 41752 - DNA, 24 bp, Homo sapiens
ttcctttactaggagcaatatcaa

SEQ ID NO: 41753 - DNA, 24 bp, Homo sapiens
attcctttactaggagcaatatca

SEQ ID NO: 41754 - DNA, 25 bp, Homo sapiens
acaactgatgaatgtggagccaatc

SEQ ID NO: 41755 - DNA, 25 bp, Homo sapiens
ggaagattgctgatgaaggaagact

SEQ ID NO: 41756 - DNA, 24 bp, Homo sapiens
gcgggtgttcagcaagtttcctat

SEQ ID NO: 41757 - DNA, 24 bp, Homo sapiens
gagaatataaagtaagttgattga

SEQ ID NO: 41758 - DNA, 24 bp, Homo sapiens
tgagaatataaagtaagttgattg

SEQ ID NO: 41759 - DNA, 24 bp, Homo sapiens
atgagaatataaagtaagttgatt

SEQ ID NO: 41760 - DNA, 24 bp, Homo sapiens
ctttataaaaggtaggtttgccca

SEQ ID NO: 41761 - DNA, 24 bp, Homo sapiens
tctttataaaaggtaggtttgccc

SEQ ID NO: 41762 - DNA, 24 bp, Homo sapiens
ttctttataaaaggtaggtttgcc

SEQ ID NO: 41763 - DNA, 24 bp, Homo sapiens
tacagacagaggatcaatatcagt

SEQ ID NO: 41764 - DNA, 24 bp, Homo sapiens
gtacagacagaggatcaatatcag

SEQ ID NO: 41765 - DNA, 24 bp, Homo sapiens
ggtacagacagaggatcaatatca

SEQ ID NO: 41766 - DNA, 23 bp, Homo sapiens
gctgctgctgctgctcctcactt

SEQ ID NO: 41767 - DNA, 23 bp, Homo sapiens
ttcagatcggacagactcgctgc

SEQ ID NO: 41768 - DNA, 23 bp, Homo sapiens
cagtgattccaagctgctcgcgc

SEQ ID NO: 41769 - DNA, 24 bp, Homo sapiens
agttgcctctttcatctgccaagc

SEQ ID NO: 41770 - DNA, 24 bp, Homo sapiens
cacggatgctgagacacctccaag

SEQ ID NO: 41771 - DNA, 23 bp, Homo sapiens
gctgctgctgctgctcctcactt

SEQ ID NO: 41772 - DNA, 24 bp, Homo sapiens
gtcccccacagattctgtacaatg

SEQ ID NO: 41773 - DNA, 24 bp, Homo sapiens
cgtcccccacagattctgtacaat

SEQ ID NO: 41774 - DNA, 24 bp, Homo sapiens
ccgtcccccacagattctgtacaa

SEQ ID NO: 41775 - DNA, 23 bp, Homo sapiens
gctgcctgcctctgcctacatag

SEQ ID NO: 41776 - DNA, 23 bp, Homo sapiens
cgtttgtgctgatgaaccgtggc

SEQ ID NO: 41777 - DNA, 23 bp, Homo sapiens
acctggtgtccatccgcacagcc

SEQ ID NO: 41778 - DNA, 25 bp, Homo sapiens
cgcttgtcaggtggttctacattgt

SEQ ID NO: 41779 - DNA, 23 bp, Homo sapiens
gctgcctgcctctgcctacatag

SEQ ID NO: 41780 - DNA, 23 bp, Homo sapiens
acctggtgtccatccgcacagcc

SEQ ID NO: 41781 - DNA, 24 bp, Homo sapiens
attggttacaggatgactatgtct

SEQ ID NO: 41782 - DNA, 24 bp, Homo sapiens
tattggttacaggatgactatgtc

SEQ ID NO: 41783 - DNA, 24 bp, Homo sapiens
gtattggttacaggatgactatgt

SEQ ID NO: 41784 - DNA, 24 bp, Homo sapiens
gtctcctgcctcttcagccgacat

SEQ ID NO: 41785 - DNA, 24 bp, Homo sapiens
ggcatcccattctcatttgtttcc

SEQ ID NO: 41786 - DNA, 24 bp, Homo sapiens
gttcggcggtggtggcatctcctc

SEQ ID NO: 41787 - DNA, 24 bp, Homo sapiens
ttgctttgcagatcctgcgtccat

SEQ ID NO: 41788 - DNA, 24 bp, Homo sapiens
cttgctttgcagatcctgcgtcca

SEQ ID NO: 41789 - DNA, 24 bp, Homo sapiens
acttgctttgcagatcctgcgtcc

SEQ ID NO: 41790 - DNA, 24 bp, Homo sapiens
gaggaggcgaaggagacggcagga

SEQ ID NO: 41791 - DNA, 24 bp, Homo sapiens
ctgccgctgctgctgctgctgctg

SEQ ID NO: 41792 - DNA, 24 bp, Homo sapiens
gggcggagcggggacgaggcggac

SEQ ID NO: 41793 - DNA, 24 bp, Homo sapiens
ttgtcacttaggttaaatgctata

SEQ ID NO: 41794 - DNA, 24 bp, Homo sapiens
tttgtcacttaggttaaatgctat

SEQ ID NO: 41795 - DNA, 24 bp, Homo sapiens
ttttgtcacttaggttaaatgcta

SEQ ID NO: 41796 - DNA, 24 bp, Homo sapiens
ctttttgacaggtaatatttgaag

SEQ ID NO: 41797 - DNA, 24 bp, Homo sapiens
tctttttgacaggtaatatttgaa

SEQ ID NO: 41798 - DNA, 24 bp, Homo sapiens
ttctttttgacaggtaatatttga

SEQ ID NO: 41799 - DNA, 24 bp, Homo sapiens
tatggctccaggtaaggccaagtt

SEQ ID NO: 41800 - DNA, 24 bp, Homo sapiens
ttatggctccaggtaaggccaagt

SEQ ID NO: 41801 - DNA, 24 bp, Homo sapiens
gttatggctccaggtaaggccaag

SEQ ID NO: 41802 - DNA, 24 bp, Homo sapiens
agcccagccaggccctcaaaacac

SEQ ID NO: 41803 - DNA, 24 bp, Homo sapiens
cagcccagccaggccctcaaaaca

SEQ ID NO: 41804 - DNA, 24 bp, Homo sapiens
ccagcccagccaggccctcaaaac

SEQ ID NO: 41805 - DNA, 23 bp, Homo sapiens
ctgctgctactgctgctgctgcc

SEQ ID NO: 41806 - DNA, 23 bp, Homo sapiens
gggcgtctgggctgcctgctcga

SEQ ID NO: 41807 - DNA, 23 bp, Homo sapiens
gtcctgcctgccgccccttcgtc

SEQ ID NO: 41808 - DNA, 23 bp, Homo sapiens
tttaccgctacgaggtgtcgccc

SEQ ID NO: 41809 - DNA, 24 bp, Homo sapiens
acgatggagtgtttggaaggtgcc

SEQ ID NO: 41810 - DNA, 23 bp, Homo sapiens
ctgctgctgctgctactgctgct

SEQ ID NO: 41811 - DNA, 24 bp, Homo sapiens
gcgacttctcaggacgacgaatct

SEQ ID NO: 41812 - DNA, 24 bp, Homo sapiens
aacaacttccgttgctgccatcgt

SEQ ID NO: 41813 - DNA, 24 bp, Homo sapiens
ctccagccaccccgcagtcacttt

SEQ ID NO: 41814 - DNA, 24 bp, Homo sapiens
aaaatttgaatgtaagtgttggat

SEQ ID NO: 41815 - DNA, 24 bp, Homo sapiens
taaaatttgaatgtaagtgttgga

SEQ ID NO: 41816 - DNA, 24 bp, Homo sapiens
ctaaaatttgaatgtaagtgttgg

SEQ ID NO: 41817 - DNA, 24 bp, Homo sapiens
aaatccagaagttgccaaagctgt

SEQ ID NO: 41818 - DNA, 24 bp, Homo sapiens
aaaatccagaagttgccaaagctg

SEQ ID NO: 41819 - DNA, 24 bp, Homo sapiens
taaaatccagaagttgccaaagct

SEQ ID NO: 41820 - DNA, 24 bp, Homo sapiens
catcctaccatatgacttcagccg

SEQ ID NO: 41821 - DNA, 24 bp, Homo sapiens
acatcctaccatatgacttcagcc

SEQ ID NO: 41822 - DNA, 24 bp, Homo sapiens
aacatcctaccatatgacttcagc

SEQ ID NO: 41823 - DNA, 24 bp, Homo sapiens
cttaaaacagaaaaaatgttttac

SEQ ID NO: 41824 - DNA, 24 bp, Homo sapiens
acttaaaacagaaaaaatgtttta

SEQ ID NO: 41825 - DNA, 24 bp, Homo sapiens
gacttaaaacagaaaaaatgtttt

SEQ ID NO: 41826 - DNA, 24 bp, Homo sapiens
gtgaggaaaccgaccagggcaaat

SEQ ID NO: 41827 - DNA, 25 bp, Homo sapiens
gctactcctcacctgccaacctcta

SEQ ID NO: 41828 - DNA, 25 bp, Homo sapiens
aactcacagatgtcaaggactcggc

SEQ ID NO: 41829 - DNA, 24 bp, Homo sapiens
tacaaactgaggagcaatatgtct

SEQ ID NO: 41830 - DNA, 24 bp, Homo sapiens
gtacaaactgaggagcaatatgtc

SEQ ID NO: 41831 - DNA, 24 bp, Homo sapiens
ggtacaaactgaggagcaatatgt

SEQ ID NO: 41832 - DNA, 24 bp, Homo sapiens
tcatgaagcaggtatgtatttaaa

SEQ ID NO: 41833 - DNA, 24 bp, Homo sapiens
ttcatgaagcaggtatgtatttaa

SEQ ID NO: 41834 - DNA, 24 bp, Homo sapiens
attcatgaagcaggtatgtattta

SEQ ID NO: 41835 - DNA, 24 bp, Homo sapiens
gcagaggcacaatctcggctcact

SEQ ID NO: 41836 - DNA, 24 bp, Homo sapiens
caattataaaggtgagagaaaaac

SEQ ID NO: 41837 - DNA, 24 bp, Homo sapiens
acaattataaaggtgagagaaaaa

SEQ ID NO: 41838 - DNA, 24 bp, Homo sapiens
cacaattataaaggtgagagaaaa

SEQ ID NO: 41839 - DNA, 24 bp, Homo sapiens
atccctcttaggtatgatttttat

SEQ ID NO: 41840 - DNA, 24 bp, Homo sapiens
catccctcttaggtatgattttta

SEQ ID NO: 41841 - DNA, 24 bp, Homo sapiens
acatccctcttaggtatgattttt

SEQ ID NO: 41842 - DNA, 24 bp, Homo sapiens
aatcacctggcactcagacctggg

SEQ ID NO: 41843 - DNA, 24 bp, Homo sapiens
aatacgagccaggtgccagggttc

SEQ ID NO: 41844 - DNA, 24 bp, Homo sapiens
ccaggtggacggcaagaatgtgac

SEQ ID NO: 41845 - DNA, 23 bp, Homo sapiens
gatggcttggtggcaatggctgg

SEQ ID NO: 41846 - DNA, 24 bp, Homo sapiens
ggaggtgttacaagcagaggcgtg

SEQ ID NO: 41847 - DNA, 23 bp, Homo sapiens
ctatgagtgccacatcctgagcc

SEQ ID NO: 41848 - DNA, 24 bp, Homo sapiens
agaatctcagaccctacttcaagt

SEQ ID NO: 41849 - DNA, 24 bp, Homo sapiens
ccagctctggcacttgcttcaggc

SEQ ID NO: 41850 - DNA, 24 bp, Homo sapiens
gctgctgctgccaccttcctcatg

SEQ ID NO: 41851 - DNA, 24 bp, Homo sapiens
ggaacaagacctttggaaccaggc

SEQ ID NO: 41852 - DNA, 24 bp, Homo sapiens
ccctacttcaagttcagcctgccc

SEQ ID NO: 41853 - DNA, 24 bp, Homo sapiens
gctgctgctgccaccttcctcatg

SEQ ID NO: 41854 - DNA, 24 bp, Homo sapiens
ccagctctggcacttgcttcaggc

SEQ ID NO: 41855 - DNA, 24 bp, Homo sapiens
gctgctgctgccaccttcctcatg

SEQ ID NO: 41856 - DNA, 24 bp, Homo sapiens
tgatgaccgaaagcccgctacctg

SEQ ID NO: 41857 - DNA, 24 bp, Homo sapiens
gatttggagaggcaactacacagc

SEQ ID NO: 41858 - DNA, 24 bp, Homo sapiens
agatttggagaggcaactacacag

SEQ ID NO: 41859 - DNA, 24 bp, Homo sapiens
gagatttggagaggcaactacaca

SEQ ID NO: 41860 - DNA, 24 bp, Homo sapiens
gcgggtgaccttggcacatacagc

SEQ ID NO: 41861 - DNA, 24 bp, Homo sapiens
ccgactcttcctggtgaagcatct

SEQ ID NO: 41862 - DNA, 24 bp, Homo sapiens
ttaagggaggctgtggctgaatgc

SEQ ID NO: 41863 - DNA, 24 bp, Homo sapiens
ggttcacgccattctcctgcctca

SEQ ID NO: 41864 - DNA, 24 bp, Homo sapiens
tcaaggattgtcagcaaggagcaa

SEQ ID NO: 41865 - DNA, 24 bp, Homo sapiens
ttcaactgggtcctgagaactggg

SEQ ID NO: 41866 - DNA, 24 bp, Homo sapiens
ttaattttgaagtaagtttttaaa

SEQ ID NO: 41867 - DNA, 24 bp, Homo sapiens
cttaattttgaagtaagtttttaa

SEQ ID NO: 41868 - DNA, 24 bp, Homo sapiens
ccttaattttgaagtaagttttta

SEQ ID NO: 41869 - DNA, 24 bp, Homo sapiens
ttattttacagccatttttagaca

SEQ ID NO: 41870 - DNA, 24 bp, Homo sapiens
tttattttacagccatttttagac

SEQ ID NO: 41871 - DNA, 24 bp, Homo sapiens
atttattttacagccatttttaga

SEQ ID NO: 41872 - DNA, 24 bp, Homo sapiens
ccaacagcagacacgcatctcggc

SEQ ID NO: 41873 - DNA, 24 bp, Homo sapiens
tgtgaaccagggcgagatgagcag

SEQ ID NO: 41874 - DNA, 24 bp, Homo sapiens
tgacgaaagagaagcctaagcgga

SEQ ID NO: 41875 - DNA, 24 bp, Homo sapiens
cggtggtgcgatctcggcttactg

SEQ ID NO: 41876 - DNA, 24 bp, Homo sapiens
gaaacatcaagtgagagtgctggg

SEQ ID NO: 41877 - DNA, 24 bp, Homo sapiens
tcagacagagctgtatgttatggt

SEQ ID NO: 41878 - DNA, 24 bp, Homo sapiens
atcaagttggtcacctccatcggc

SEQ ID NO: 41879 - DNA, 24 bp, Homo sapiens
atcttcctggagaactaccgtgtg

SEQ ID NO: 41880 - DNA, 24 bp, Homo sapiens
caggcacaggcaacatgaagttca

SEQ ID NO: 41881 - DNA, 24 bp, Homo sapiens
cagaataagaccaatggcatcacc

SEQ ID NO: 41882 - DNA, 24 bp, Homo sapiens
cggtggctgctgctgtgcaacccg

SEQ ID NO: 41883 - DNA, 24 bp, Homo sapiens
tcccggatcaggcaagtatttagt

SEQ ID NO: 41884 - DNA, 24 bp, Homo sapiens
ttcccggatcaggcaagtatttag

SEQ ID NO: 41885 - DNA, 24 bp, Homo sapiens
cttcccggatcaggcaagtattta

SEQ ID NO: 41886 - DNA, 23 bp, Homo sapiens
actggtggctgtggtatcagggc

SEQ ID NO: 41887 - DNA, 24 bp, Homo sapiens
attatgaggtgctggtgctgggtg

SEQ ID NO: 41888 - DNA, 25 bp, Homo sapiens
gccattgttgagcccagtgagagac

SEQ ID NO: 41889 - DNA, 23 bp, Homo sapiens
cagcctaaaggcctgccctgatg

SEQ ID NO: 41890 - DNA, 23 bp, Homo sapiens
cccgcacccccaccccctgccca

SEQ ID NO: 41891 - DNA, 24 bp, Homo sapiens
ctcctccgcctccgcctcctcctg

SEQ ID NO: 41892 - DNA, 24 bp, Homo sapiens
gatgaacggcttctcgctgggtga

SEQ ID NO: 41893 - DNA, 24 bp, Homo sapiens
gccagccagccagccagccagccg

SEQ ID NO: 41894 - DNA, 24 bp, Homo sapiens
aaaaataacaggaatacaaacaga

SEQ ID NO: 41895 - DNA, 24 bp, Homo sapiens
aaaaaataacaggaatacaaacag

SEQ ID NO: 41896 - DNA, 24 bp, Homo sapiens
gaaaaaataacaggaatacaaaca

SEQ ID NO: 41897 - DNA, 23 bp, Homo sapiens
aaggcacgatcatggctcacggc

SEQ ID NO: 41898 - DNA, 23 bp, Homo sapiens
atgggctcaagcgatcctcctgc

SEQ ID NO: 41899 - DNA, 23 bp, Homo sapiens
ctcccaagtagctagcctacagg

SEQ ID NO: 41900 - DNA, 23 bp, Homo sapiens
cctcgacctcctcagagcagccg

SEQ ID NO: 41901 - DNA, 23 bp, Homo sapiens
accgcctcctcctgctgctgctg

SEQ ID NO: 41902 - DNA, 25 bp, Homo sapiens
tcacagcagtagagtaccaagaggc

SEQ ID NO: 41903 - DNA, 23 bp, Homo sapiens
aggaggagctggacgccatgctg

SEQ ID NO: 41904 - DNA, 23 bp, Homo sapiens
cctcacgctctttggggagaagc

SEQ ID NO: 41905 - DNA, 23 bp, Homo sapiens
ggcaagggccccatcaacttcac

SEQ ID NO: 41906 - DNA, 23 bp, Homo sapiens
agcgtgacatggaggactgggtg

SEQ ID NO: 41907 - DNA, 23 bp, Homo sapiens
acagtccaccacgagcggaagta

SEQ ID NO: 41908 - DNA, 25 bp, Homo sapiens
ggtggagcagtgtgtggacttcatc

SEQ ID NO: 41909 - DNA, 24 bp, Homo sapiens
tgttgtttcaggctggagtgagca

SEQ ID NO: 41910 - DNA, 24 bp, Homo sapiens
ctgttgtttcaggctggagtgagc

SEQ ID NO: 41911 - DNA, 24 bp, Homo sapiens
actgttgtttcaggctggagtgag

SEQ ID NO: 41912 - DNA, 24 bp, Homo sapiens
caccatatgtggtattttaagaaa

SEQ ID NO: 41913 - DNA, 24 bp, Homo sapiens
gcaccatatgtggtattttaagaa

SEQ ID NO: 41914 - DNA, 24 bp, Homo sapiens
agcaccatatgtggtattttaaga

SEQ ID NO: 41915 - DNA, 24 bp, Homo sapiens
aatttagacaggtatggaattttt

SEQ ID NO: 41916 - DNA, 24 bp, Homo sapiens
aaatttagacaggtatggaatttt

SEQ ID NO: 41917 - DNA, 24 bp, Homo sapiens
gaaatttagacaggtatggaattt

SEQ ID NO: 41918 - DNA, 24 bp, Homo sapiens
ctgctctcaagacgacgactgcct

SEQ ID NO: 41919 - DNA, 24 bp, Homo sapiens
cggctcctccttcaacttcagaaa

SEQ ID NO: 41920 - DNA, 24 bp, Homo sapiens
catctccatcaccgcccagagcag

SEQ ID NO: 41921 - DNA, 23 bp, Homo sapiens
aggagcctggagcagtatgacca

SEQ ID NO: 41922 - DNA, 23 bp, Homo sapiens
ccaacctgagcgaaggcgtctcc

SEQ ID NO: 41923 - DNA, 24 bp, Homo sapiens
aaaggcgacccgttccagaatgac

SEQ ID NO: 41924 - DNA, 25 bp, Homo sapiens
caacagcaacctgaggagcataggc

SEQ ID NO: 41925 - DNA, 25 bp, Homo sapiens
ggaagaggaagaggaaccagagcaa

SEQ ID NO: 41926 - DNA, 25 bp, Homo sapiens
agcaagagccagaatcagaagagga

SEQ ID NO: 41927 - DNA, 25 bp, Homo sapiens
gcccaagatggtctcaaactcctgg

SEQ ID NO: 41928 - DNA, 23 bp, Homo sapiens
aatcctcctgccttggcctcctc

SEQ ID NO: 41929 - DNA, 23 bp, Homo sapiens
ctctccttcctctccccaagtcc

SEQ ID NO: 41930 - DNA, 24 bp, Homo sapiens
accctgtccaggctgaatccacct

SEQ ID NO: 41931 - DNA, 24 bp, Homo sapiens
caccctgtccaggctgaatccacc

SEQ ID NO: 41932 - DNA, 24 bp, Homo sapiens
ccaccctgtccaggctgaatccac

SEQ ID NO: 41933 - DNA, 24 bp, Homo sapiens
attgtttctagtgaatatttggca

SEQ ID NO: 41934 - DNA, 24 bp, Homo sapiens
tattgtttctagtgaatatttggc

SEQ ID NO: 41935 - DNA, 24 bp, Homo sapiens
atattgtttctagtgaatatttgg

SEQ ID NO: 41936 - DNA, 24 bp, Homo sapiens
tccatattctggtgtacgtccgtg

SEQ ID NO: 41937 - DNA, 24 bp, Homo sapiens
atccatattctggtgtacgtccgt

SEQ ID NO: 41938 - DNA, 24 bp, Homo sapiens
gatccatattctggtgtacgtccg

SEQ ID NO: 41939 - DNA, 25 bp, Homo sapiens
acccatgaactgaagccctatgtca

SEQ ID NO: 41940 - DNA, 25 bp, Homo sapiens
aatgccaaggttattactgactact

SEQ ID NO: 41941 - DNA, 25 bp, Homo sapiens
aagccatcgaatatgaggtgtatga

SEQ ID NO: 41942 - DNA, 24 bp, Homo sapiens
cattttcccaagtatataatctgc

SEQ ID NO: 41943 - DNA, 24 bp, Homo sapiens
gcattttcccaagtatataatctg

SEQ ID NO: 41944 - DNA, 24 bp, Homo sapiens
agcattttcccaagtatataatct

SEQ ID NO: 41945 - DNA, 24 bp, Homo sapiens
ggtggtgtgaagtggtgcaatcat

SEQ ID NO: 41946 - DNA, 24 bp, Homo sapiens
tcctgccttagctgagactacatg

SEQ ID NO: 41947 - DNA, 24 bp, Homo sapiens
ctgtggcctcaaactactgggctc

SEQ ID NO: 41948 - DNA, 24 bp, Homo sapiens
gcggcggctgctgattgtgttcta

SEQ ID NO: 41949 - DNA, 24 bp, Homo sapiens
gcttccctatttcctggttcgccg

SEQ ID NO: 41950 - DNA, 24 bp, Homo sapiens
cctttctttcgattacccgtggcg

SEQ ID NO: 41951 - DNA, 24 bp, Homo sapiens
tcaagcttcaataatgttaaacag

SEQ ID NO: 41952 - DNA, 24 bp, Homo sapiens
atcaagcttcaataatgttaaaca

SEQ ID NO: 41953 - DNA, 24 bp, Homo sapiens
aatcaagcttcaataatgttaaac

SEQ ID NO: 41954 - DNA, 24 bp, Homo sapiens
aaagtcaccgccgctagggtcgcc

SEQ ID NO: 41955 - DNA, 24 bp, Homo sapiens
catcaacgcaccggggtcctgtca

SEQ ID NO: 41956 - DNA, 24 bp, Homo sapiens
gagccgctgctgccgccgccgccg

SEQ ID NO: 41957 - DNA, 24 bp, Homo sapiens
tcccctggaagagcacggacccct

SEQ ID NO: 41958 - DNA, 24 bp, Homo sapiens
ggcctcccgccgccccttgcagct

SEQ ID NO: 41959 - DNA, 24 bp, Homo sapiens
gccacagggagtccccaggagccc

SEQ ID NO: 41960 - DNA, 24 bp, Homo sapiens
gatatcaccagagctgatgttttt

SEQ ID NO: 41961 - DNA, 24 bp, Homo sapiens
tgatatcaccagagctgatgtttt

SEQ ID NO: 41962 - DNA, 24 bp, Homo sapiens
atgatatcaccagagctgatgttt

SEQ ID NO: 41963 - DNA, 24 bp, Homo sapiens
accctgtaaagatttatgtgatcc

SEQ ID NO: 41964 - DNA, 24 bp, Homo sapiens
taccctgtaaagatttatgtgatc

SEQ ID NO: 41965 - DNA, 24 bp, Homo sapiens
ctaccctgtaaagatttatgtgat

SEQ ID NO: 41966 - DNA, 23 bp, Homo sapiens
gcgcgaggacccgagccaggcgg

SEQ ID NO: 41967 - DNA, 23 bp, Homo sapiens
gccaacgacccaaaaaaggccgg

SEQ ID NO: 41968 - DNA, 24 bp, Homo sapiens
gcctgtctgactgtctccttctct

SEQ ID NO: 41969 - DNA, 25 bp, Homo sapiens
tgctgctcatggttgatgattctcc

SEQ ID NO: 41970 - DNA, 23 bp, Homo sapiens
ctctgtgacctgcctgctgcctc

SEQ ID NO: 41971 - DNA, 24 bp, Homo sapiens
gcctgtctgactgtctccttctct

SEQ ID NO: 41972 - DNA, 23 bp, Homo sapiens
ctctgtgacctgcctgctgcctc

SEQ ID NO: 41973 - DNA, 23 bp, Homo sapiens
ggactccacgacagacgagcagc

SEQ ID NO: 41974 - DNA, 24 bp, Homo sapiens
cctgtccgcagcgccgtggggaag

SEQ ID NO: 41975 - DNA, 24 bp, Homo sapiens
ccctgtccgcagcgccgtggggaa

SEQ ID NO: 41976 - DNA, 24 bp, Homo sapiens
gccctgtccgcagcgccgtgggga

SEQ ID NO: 41977 - DNA, 24 bp, Homo sapiens
gaagttctaaggaagtatgtgagg

SEQ ID NO: 41978 - DNA, 24 bp, Homo sapiens
tgaagttctaaggaagtatgtgag

SEQ ID NO: 41979 - DNA, 24 bp, Homo sapiens
atgaagttctaaggaagtatgtga

SEQ ID NO: 41980 - DNA, 24 bp, Homo sapiens
aatgacaaaaggtgaattatagtt

SEQ ID NO: 41981 - DNA, 24 bp, Homo sapiens
taatgacaaaaggtgaattatagt

SEQ ID NO: 41982 - DNA, 24 bp, Homo sapiens
ttaatgacaaaaggtgaattatag

SEQ ID NO: 41983 - DNA, 24 bp, Homo sapiens
tagagtctgaacagagcaccagca

SEQ ID NO: 41984 - DNA, 24 bp, Homo sapiens
cgtgagataatgagagaaggcagt

SEQ ID NO: 41985 - DNA, 24 bp, Homo sapiens
aggatgacgacatgttagtaagca

SEQ ID NO: 41986 - DNA, 25 bp, Homo sapiens
tcatttgtctacaccatcaaggagg

SEQ ID NO: 41987 - DNA, 25 bp, Homo sapiens
attcttattgccaagtcccctctgg

SEQ ID NO: 41988 - DNA, 25 bp, Homo sapiens
cggctgatcctccagtaccttgatt

SEQ ID NO: 41989 - DNA, 25 bp, Homo sapiens
tgtctacaccatcaaggaggaaggc

SEQ ID NO: 41990 - DNA, 24 bp, Homo sapiens
agaaatcctcccacctcagcctcc

SEQ ID NO: 41991 - DNA, 24 bp, Homo sapiens
cgagcaagaagacagatccgcaga

SEQ ID NO: 41992 - DNA, 24 bp, Homo sapiens
aggagggcagaaagcagaaacagt

SEQ ID NO: 41993 - DNA, 24 bp, Homo sapiens
cagtccgtgcttggatctggaaca

SEQ ID NO: 41994 - DNA, 24 bp, Homo sapiens
tccacccgcttcagcctcccaaag

SEQ ID NO: 41995 - DNA, 24 bp, Homo sapiens
caacctacacgtcgtggagctgac

SEQ ID NO: 41996 - DNA, 24 bp, Homo sapiens
gccagtttatgcctctttaatgct

SEQ ID NO: 41997 - DNA, 25 bp, Homo sapiens
aactgaagacctctactgccatcct

SEQ ID NO: 41998 - DNA, 23 bp, Homo sapiens
cgggtgctgctggctcagttctc

SEQ ID NO: 41999 - DNA, 23 bp, Homo sapiens
ccccgtgaatggcgctgatctcc

SEQ ID NO: 42000 - DNA, 25 bp, Homo sapiens
aactgaagacctctactgccatcct

SEQ ID NO: 42001 - DNA, 23 bp, Homo sapiens
cgggtgctgctggctcagttctc

SEQ ID NO: 42002 - DNA, 25 bp, Homo sapiens
gctcagaaatgtggcttgtcttaca

SEQ ID NO: 42003 - DNA, 23 bp, Homo sapiens
cgtctcagtgcggcgattcttcc

SEQ ID NO: 42004 - DNA, 23 bp, Homo sapiens
acgctcagcaacctcatgttcct

SEQ ID NO: 42005 - DNA, 23 bp, Homo sapiens
cacggacaacagcacagcccaga

SEQ ID NO: 42006 - DNA, 23 bp, Homo sapiens
gccgctgctgctgctgctgcttg

SEQ ID NO: 42007 - DNA, 23 bp, Homo sapiens
cgagcgcggagccatgggccggg

SEQ ID NO: 42008 - DNA, 23 bp, Homo sapiens
ccgggaccgggggcgaggcggtg

SEQ ID NO: 42009 - DNA, 24 bp, Homo sapiens
ttattatttaggaatccaaatgag

SEQ ID NO: 42010 - DNA, 24 bp, Homo sapiens
tttattatttaggaatccaaatga

SEQ ID NO: 42011 - DNA, 24 bp, Homo sapiens
ttttattatttaggaatccaaatg

SEQ ID NO: 42012 - DNA, 24 bp, Homo sapiens
gcaaaatatgggaaatattgatga

SEQ ID NO: 42013 - DNA, 24 bp, Homo sapiens
tgcaaaatatgggaaatattgatg

SEQ ID NO: 42014 - DNA, 24 bp, Homo sapiens
ttgcaaaatatgggaaatattgat

SEQ ID NO: 42015 - DNA, 24 bp, Homo sapiens
caacttaaaaatgccatctcctcc

SEQ ID NO: 42016 - DNA, 24 bp, Homo sapiens
ccaacttaaaaatgccatctcctc

SEQ ID NO: 42017 - DNA, 24 bp, Homo sapiens
accaacttaaaaatgccatctcct

SEQ ID NO: 42018 - DNA, 24 bp, Homo sapiens
aaataaaacaggtatttctccttg

SEQ ID NO: 42019 - DNA, 24 bp, Homo sapiens
taaataaaacaggtatttctcctt

SEQ ID NO: 42020 - DNA, 24 bp, Homo sapiens
ttaaataaaacaggtatttctcct

SEQ ID NO: 42021 - DNA, 24 bp, Homo sapiens
ctgctgctggcgttcgtgaccaag

SEQ ID NO: 42022 - DNA, 24 bp, Homo sapiens
tctgctcaagagtgaagacaaggt

SEQ ID NO: 42023 - DNA, 24 bp, Homo sapiens
cctcgtccttcaactccaacacct

SEQ ID NO: 42024 - DNA, 24 bp, Homo sapiens
atgttaatgaggtaacctacaact

SEQ ID NO: 42025 - DNA, 24 bp, Homo sapiens
aatgttaatgaggtaacctacaac

SEQ ID NO: 42026 - DNA, 24 bp, Homo sapiens
caatgttaatgaggtaacctacaa

SEQ ID NO: 42027 - DNA, 24 bp, Homo sapiens
tctaccctaagaacacagatctat

SEQ ID NO: 42028 - DNA, 24 bp, Homo sapiens
ctctaccctaagaacacagatcta

SEQ ID NO: 42029 - DNA, 24 bp, Homo sapiens
actctaccctaagaacacagatct

SEQ ID NO: 42030 - DNA, 24 bp, Homo sapiens
aaggggaaggtgccgtgtcaagcc

SEQ ID NO: 42031 - DNA, 24 bp, Homo sapiens
agacgagacctctgccctgaagac

SEQ ID NO: 42032 - DNA, 24 bp, Homo sapiens
caccagcccgtgggctgccccctg

SEQ ID NO: 42033 - DNA, 24 bp, Homo sapiens
agcagaacttgagtcaagtaaaga

SEQ ID NO: 42034 - DNA, 24 bp, Homo sapiens
tagcagaacttgagtcaagtaaag

SEQ ID NO: 42035 - DNA, 24 bp, Homo sapiens
ttagcagaacttgagtcaagtaaa

SEQ ID NO: 42036 - DNA, 24 bp, Homo sapiens
acatcttacttagtttatgcgaat

SEQ ID NO: 42037 - DNA, 24 bp, Homo sapiens
tacatcttacttagtttatgcgaa

SEQ ID NO: 42038 - DNA, 24 bp, Homo sapiens
ttacatcttacttagtttatgcga

SEQ ID NO: 42039 - DNA, 24 bp, Homo sapiens
ggcagaaaatgatgaatccatgca

SEQ ID NO: 42040 - DNA, 24 bp, Homo sapiens
tggcagaaaatgatgaatccatgc

SEQ ID NO: 42041 - DNA, 24 bp, Homo sapiens
ttggcagaaaatgatgaatccatg

SEQ ID NO: 42042 - DNA, 24 bp, Homo sapiens
ttccctcccagcggtggagacaca

SEQ ID NO: 42043 - DNA, 24 bp, Homo sapiens
cttccctcccagcggtggagacac

SEQ ID NO: 42044 - DNA, 24 bp, Homo sapiens
gcttccctcccagcggtggagaca

SEQ ID NO: 42045 - DNA, 24 bp, Homo sapiens
caataaggagcgactctttgcggc

SEQ ID NO: 42046 - DNA, 24 bp, Homo sapiens
gcctttcgagatgctgagccctag

SEQ ID NO: 42047 - DNA, 24 bp, Homo sapiens
ctgaagacctcgcccgcccactgc

SEQ ID NO: 42048 - DNA, 24 bp, Homo sapiens
ctatccattaggttttattaatgt

SEQ ID NO: 42049 - DNA, 24 bp, Homo sapiens
tctatccattaggttttattaatg

SEQ ID NO: 42050 - DNA, 24 bp, Homo sapiens
ttctatccattaggttttattaat

SEQ ID NO: 42051 - DNA, 24 bp, Homo sapiens
ttcttccctagagttaaataaaat

SEQ ID NO: 42052 - DNA, 24 bp, Homo sapiens
tttcttccctagagttaaataaaa

SEQ ID NO: 42053 - DNA, 24 bp, Homo sapiens
ttttcttccctagagttaaataaa

SEQ ID NO: 42054 - DNA, 24 bp, Homo sapiens
aaccattttaggattattgctatg

SEQ ID NO: 42055 - DNA, 24 bp, Homo sapiens
caaccattttaggattattgctat

SEQ ID NO: 42056 - DNA, 24 bp, Homo sapiens
tcaaccattttaggattattgcta

SEQ ID NO: 42057 - DNA, 25 bp, Homo sapiens
agaagatggatggatgtgggttaca

SEQ ID NO: 42058 - DNA, 25 bp, Homo sapiens
cgggaagaagatccacatgaaggaa

SEQ ID NO: 42059 - DNA, 25 bp, Homo sapiens
ccctcagataatactcctggcgatt

SEQ ID NO: 42060 - DNA, 25 bp, Homo sapiens
ggtccgacgcctccttatattgtga

SEQ ID NO: 42061 - DNA, 23 bp, Homo sapiens
ggctgctggagaggctgacggac

SEQ ID NO: 42062 - DNA, 23 bp, Homo sapiens
cgacttcctcaacaccttcctgc

SEQ ID NO: 42063 - DNA, 24 bp, Homo sapiens
tttaattttaggtaagtgcattct

SEQ ID NO: 42064 - DNA, 24 bp, Homo sapiens
ctttaattttaggtaagtgcattc

SEQ ID NO: 42065 - DNA, 24 bp, Homo sapiens
actttaattttaggtaagtgcatt

SEQ ID NO: 42066 - DNA, 24 bp, Homo sapiens
caactacaacggcgtgctggagat

SEQ ID NO: 42067 - DNA, 24 bp, Homo sapiens
gagaaatgggtggcagtggcggac

SEQ ID NO: 42068 - DNA, 24 bp, Homo sapiens
aaccagccaacacttcaatgacat

SEQ ID NO: 42069 - DNA, 24 bp, Homo sapiens
caaaattttagcaaacttctgaat

SEQ ID NO: 42070 - DNA, 24 bp, Homo sapiens
tcaaaattttagcaaacttctgaa

SEQ ID NO: 42071 - DNA, 24 bp, Homo sapiens
ttcaaaattttagcaaacttctga

SEQ ID NO: 42072 - DNA, 24 bp, Homo sapiens
ttcttgcggctgctgctgtctatc

SEQ ID NO: 42073 - DNA, 25 bp, Homo sapiens
ggtccagttagccacgaggtacagg

SEQ ID NO: 42074 - DNA, 25 bp, Homo sapiens
agtgctagaggatcacagatgttcg

SEQ ID NO: 42075 - DNA, 24 bp, Homo sapiens
tttctaaaaaggtatttaatgctc

SEQ ID NO: 42076 - DNA, 24 bp, Homo sapiens
ttttctaaaaaggtatttaatgct

SEQ ID NO: 42077 - DNA, 24 bp, Homo sapiens
cttttctaaaaaggtatttaatgc

SEQ ID NO: 42078 - DNA, 24 bp, Homo sapiens
aattcctccactacctgatgtgcc

SEQ ID NO: 42079 - DNA, 24 bp, Homo sapiens
aatgtgtcgccgaggaatgtagca

SEQ ID NO: 42080 - DNA, 24 bp, Homo sapiens
tggtaagcagcattgaagaagatg

SEQ ID NO: 42081 - DNA, 24 bp, Homo sapiens
tgaagccaagaacattccagcctt

SEQ ID NO: 42082 - DNA, 24 bp, Homo sapiens
tattcagagtggcagcaattacgc

SEQ ID NO: 42083 - DNA, 24 bp, Homo sapiens
tggaatcacaggtagcagcagcac

SEQ ID NO: 42084 - DNA, 24 bp, Homo sapiens
tggaatcacaggtagcagcagcac

SEQ ID NO: 42085 - DNA, 24 bp, Homo sapiens
gccatacattgttacaggtgctga

SEQ ID NO: 42086 - DNA, 24 bp, Homo sapiens
atctggacctggagcctctgagtg

SEQ ID NO: 42087 - DNA, 25 bp, Homo sapiens
cggcattctacgataagtgtccaat

SEQ ID NO: 42088 - DNA, 23 bp, Homo sapiens
cagaaggtgctggacgaatgcca

SEQ ID NO: 42089 - DNA, 24 bp, Homo sapiens
cacctcctggtcaatagccgtgtt

SEQ ID NO: 42090 - DNA, 24 bp, Homo sapiens
tggtggaccaggcctgggatgcac

SEQ ID NO: 42091 - DNA, 24 bp, Homo sapiens
atggtggaccaggcctgggatgca

SEQ ID NO: 42092 - DNA, 24 bp, Homo sapiens
aatggtggaccaggcctgggatgc

SEQ ID NO: 42093 - DNA, 24 bp, Homo sapiens
gccttgttgctgtaactgctgctc

SEQ ID NO: 42094 - DNA, 24 bp, Homo sapiens
cgatgtcaagctcttcctggctcc

SEQ ID NO: 42095 - DNA, 25 bp, Homo sapiens
attcagtggatgtgatcttggctca

SEQ ID NO: 42096 - DNA, 24 bp, Homo sapiens
tgggatttaagtaaaattggagag

SEQ ID NO: 42097 - DNA, 24 bp, Homo sapiens
ctgggatttaagtaaaattggaga

SEQ ID NO: 42098 - DNA, 24 bp, Homo sapiens
tctgggatttaagtaaaattggag

SEQ ID NO: 42099 - DNA, 24 bp, Homo sapiens
gctcactgcaacttccacctccca

SEQ ID NO: 42100 - DNA, 24 bp, Homo sapiens
acccaggctggagtgcaatggtgc

SEQ ID NO: 42101 - DNA, 24 bp, Homo sapiens
ccgggaggcaggtgtgctgatgta

SEQ ID NO: 42102 - DNA, 24 bp, Homo sapiens
accgggaggcaggtgtgctgatgt

SEQ ID NO: 42103 - DNA, 24 bp, Homo sapiens
taccgggaggcaggtgtgctgatg

SEQ ID NO: 42104 - DNA, 24 bp, Homo sapiens
ctaaaagaagaggaaaagaaaaag

SEQ ID NO: 42105 - DNA, 24 bp, Homo sapiens
actaaaagaagaggaaaagaaaaa

SEQ ID NO: 42106 - DNA, 24 bp, Homo sapiens
gactaaaagaagaggaaaagaaaa

SEQ ID NO: 42107 - DNA, 24 bp, Homo sapiens
ttttacgacagggattctgataat

SEQ ID NO: 42108 - DNA, 24 bp, Homo sapiens
tttttacgacagggattctgataa

SEQ ID NO: 42109 - DNA, 24 bp, Homo sapiens
atttttacgacagggattctgata

SEQ ID NO: 42110 - DNA, 24 bp, Homo sapiens
agctgctacagggaaaagaaaaag

SEQ ID NO: 42111 - DNA, 24 bp, Homo sapiens
gagctgctacagggaaaagaaaaa

SEQ ID NO: 42112 - DNA, 24 bp, Homo sapiens
ggagctgctacagggaaaagaaaa

SEQ ID NO: 42113 - DNA, 23 bp, Homo sapiens
gctttcggacgccttcctgagcc

SEQ ID NO: 42114 - DNA, 23 bp, Homo sapiens
ctgagccgctgccgacgcctcat

SEQ ID NO: 42115 - DNA, 23 bp, Homo sapiens
gcccagctcttggatcagtctgc

SEQ ID NO: 42116 - DNA, 23 bp, Homo sapiens
agctgactgcaaggacagagagg

SEQ ID NO: 42117 - DNA, 23 bp, Homo sapiens
ggagcccagcctgccccgaggag

SEQ ID NO: 42118 - DNA, 24 bp, Homo sapiens
tagatacaaaggtaagttaaaaag

SEQ ID NO: 42119 - DNA, 24 bp, Homo sapiens
atagatacaaaggtaagttaaaaa

SEQ ID NO: 42120 - DNA, 24 bp, Homo sapiens
aatagatacaaaggtaagttaaaa

SEQ ID NO: 42121 - DNA, 25 bp, Homo sapiens
tttcacacatcacagtcttgggtct

SEQ ID NO: 42122 - DNA, 25 bp, Homo sapiens
tgaacagaataggactgagtacggt

SEQ ID NO: 42123 - DNA, 25 bp, Homo sapiens
tggagactgtgtgatggataaacct

SEQ ID NO: 42124 - DNA, 24 bp, Homo sapiens
tagatacaaagatgaagaaagaaa

SEQ ID NO: 42125 - DNA, 24 bp, Homo sapiens
atagatacaaagatgaagaaagaa

SEQ ID NO: 42126 - DNA, 24 bp, Homo sapiens
aatagatacaaagatgaagaaaga

SEQ ID NO: 42127 - DNA, 24 bp, Homo sapiens
acttttataaggtgagatgaaaac

SEQ ID NO: 42128 - DNA, 24 bp, Homo sapiens
tacttttataaggtgagatgaaaa

SEQ ID NO: 42129 - DNA, 24 bp, Homo sapiens
ttacttttataaggtgagatgaaa

SEQ ID NO: 42130 - DNA, 24 bp, Homo sapiens
actgataataggtaaatatctagt

SEQ ID NO: 42131 - DNA, 24 bp, Homo sapiens
tactgataataggtaaatatctag

SEQ ID NO: 42132 - DNA, 24 bp, Homo sapiens
ttactgataataggtaaatatcta

SEQ ID NO: 42133 - DNA, 24 bp, Homo sapiens
ataatccacagaacctaccttctg

SEQ ID NO: 42134 - DNA, 24 bp, Homo sapiens
gataatccacagaacctaccttct

SEQ ID NO: 42135 - DNA, 24 bp, Homo sapiens
ggataatccacagaacctaccttc

SEQ ID NO: 42136 - DNA, 24 bp, Homo sapiens
ctgctcccattcttgctgacccac

SEQ ID NO: 42137 - DNA, 25 bp, Homo sapiens
aagtcttcaaccggcctatcctctt

SEQ ID NO: 42138 - DNA, 23 bp, Homo sapiens
caaagcccctgcccctcagccgc

SEQ ID NO: 42139 - DNA, 24 bp, Homo sapiens
ggagcctggtggtgattgacctaa

SEQ ID NO: 42140 - DNA, 24 bp, Homo sapiens
tggagcctggtggtgattgaccta

SEQ ID NO: 42141 - DNA, 24 bp, Homo sapiens
ttggagcctggtggtgattgacct

SEQ ID NO: 42142 - DNA, 24 bp, Homo sapiens
tttttaaataggtaataaatctcc

SEQ ID NO: 42143 - DNA, 24 bp, Homo sapiens
ttttttaaataggtaataaatctc

SEQ ID NO: 42144 - DNA, 24 bp, Homo sapiens
attttttaaataggtaataaatct

SEQ ID NO: 42145 - DNA, 23 bp, Homo sapiens
ctctggcggtggtggttaagacg

SEQ ID NO: 42146 - DNA, 23 bp, Homo sapiens
cggcagcggcggcgacagctctg

SEQ ID NO: 42147 - DNA, 23 bp, Homo sapiens
gcgtctcggggtgtgtcggccgc

SEQ ID NO: 42148 - DNA, 25 bp, Homo sapiens
ttcaggagatggagtcagacaagaa

SEQ ID NO: 42149 - DNA, 23 bp, Homo sapiens
cagggtgacagcagtgggaatcg

SEQ ID NO: 42150 - DNA, 25 bp, Homo sapiens
atctcgctgctcttcaatgccatcc

SEQ ID NO: 42151 - DNA, 25 bp, Homo sapiens
tgtgtaagtttgctgatggaggaca

SEQ ID NO: 42152 - DNA, 25 bp, Homo sapiens
acagaacccaaacaaatacatccct

SEQ ID NO: 42153 - DNA, 25 bp, Homo sapiens
aggagaggtgagacttgctggaatg

SEQ ID NO: 42154 - DNA, 24 bp, Homo sapiens
agggcacctgggtaatgttttaaa

SEQ ID NO: 42155 - DNA, 24 bp, Homo sapiens
aagggcacctgggtaatgttttaa

SEQ ID NO: 42156 - DNA, 24 bp, Homo sapiens
gaagggcacctgggtaatgtttta

SEQ ID NO: 42157 - DNA, 24 bp, Homo sapiens
actccaagaccttcgaccagctca

SEQ ID NO: 42158 - DNA, 24 bp, Homo sapiens
agagcttccagtacgaccacgagg

SEQ ID NO: 42159 - DNA, 24 bp, Homo sapiens
ggctgctgctggcgctggtgctgg

SEQ ID NO: 42160 - DNA, 24 bp, Homo sapiens
aaaaaatacaagtaagttctctgc

SEQ ID NO: 42161 - DNA, 24 bp, Homo sapiens
taaaaaatacaagtaagttctctg

SEQ ID NO: 42162 - DNA, 24 bp, Homo sapiens
ttaaaaaatacaagtaagttctct

SEQ ID NO: 42163 - DNA, 24 bp, Homo sapiens
cttcaaaaaaggtattttatttcc

SEQ ID NO: 42164 - DNA, 24 bp, Homo sapiens
acttcaaaaaaggtattttatttc

SEQ ID NO: 42165 - DNA, 24 bp, Homo sapiens
tacttcaaaaaaggtattttattt

SEQ ID NO: 42166 - DNA, 24 bp, Homo sapiens
gccccagcccctgtcccagtccta

SEQ ID NO: 42167 - DNA, 24 bp, Homo sapiens
gcccctccccaagtcctgccccag

SEQ ID NO: 42168 - DNA, 24 bp, Homo sapiens
tgctccagccatggtatcagctct

SEQ ID NO: 42169 - DNA, 24 bp, Homo sapiens
gaccccggccatggacgaactgtt

SEQ ID NO: 42170 - DNA, 24 bp, Homo sapiens
ggcgaatggctcgtctgtagtgca

SEQ ID NO: 42171 - DNA, 24 bp, Homo sapiens
gcccagctgcgaccccggccccgc

SEQ ID NO: 42172 - DNA, 24 bp, Homo sapiens
ccgacctctcctcactctcgctcg

SEQ ID NO: 42173 - DNA, 24 bp, Homo sapiens
gatcgtccaccagaccgtgcctcc

SEQ ID NO: 42174 - DNA, 24 bp, Homo sapiens
catgccgagtcgccgcgtcgccag

SEQ ID NO: 42175 - DNA, 24 bp, Homo sapiens
aagaggctgacacttggcaacacc

SEQ ID NO: 42176 - DNA, 24 bp, Homo sapiens
gaaggaacgaggtgtggacatggc

SEQ ID NO: 42177 - DNA, 24 bp, Homo sapiens
cctcaagagaatgccctcaatccg

SEQ ID NO: 42178 - DNA, 24 bp, Homo sapiens
cctggagtgctacaactgcggctg

SEQ ID NO: 42179 - DNA, 24 bp, Homo sapiens
tgactcagtggtggtgctgctgtg

SEQ ID NO: 42180 - DNA, 24 bp, Homo sapiens
ccagagcagcctcaaggacatcaa

SEQ ID NO: 42181 - DNA, 23 bp, Homo sapiens
ctgcgtctgctgttgctgctgct

SEQ ID NO: 42182 - DNA, 23 bp, Homo sapiens
cacgggcgatggcgaaggcgacg

SEQ ID NO: 42183 - DNA, 23 bp, Homo sapiens
tagccgcagtccctccagccgtg

SEQ ID NO: 42184 - DNA, 24 bp, Homo sapiens
cacggctgcatgagaacaactgga

SEQ ID NO: 42185 - DNA, 23 bp, Homo sapiens
cgagggatgcttactgggagaag

SEQ ID NO: 42186 - DNA, 23 bp, Homo sapiens
gtctgctgttgctgctgctgctg

SEQ ID NO: 42187 - DNA, 24 bp, Homo sapiens
taaaaaacacgcaaagtttggtaa

SEQ ID NO: 42188 - DNA, 24 bp, Homo sapiens
ataaaaaacacgcaaagtttggta

SEQ ID NO: 42189 - DNA, 24 bp, Homo sapiens
gataaaaaacacgcaaagtttggt

SEQ ID NO: 42190 - DNA, 24 bp, Homo sapiens
ccaccgcacccagccaagaagact

SEQ ID NO: 42191 - DNA, 24 bp, Homo sapiens
gcttcgggtgaactctagtccctg

SEQ ID NO: 42192 - DNA, 25 bp, Homo sapiens
tggatttgcctattctggacatttc

SEQ ID NO: 42193 - DNA, 24 bp, Homo sapiens
gccacagaccctgaatgatctcat

SEQ ID NO: 42194 - DNA, 25 bp, Homo sapiens
tcaggacattctgagtaccattcag

SEQ ID NO: 42195 - DNA, 24 bp, Homo sapiens
gctacagtggcataaggaggaaga

SEQ ID NO: 42196 - DNA, 23 bp, Homo sapiens
tgcctgttgccgcccactcagca

SEQ ID NO: 42197 - DNA, 25 bp, Homo sapiens
actttggcaagatcatcagagagat

SEQ ID NO: 42198 - DNA, 24 bp, Homo sapiens
gttacaggaagtcccttgccatcc

SEQ ID NO: 42199 - DNA, 24 bp, Homo sapiens
ccaccccacttctctctaaggaga

SEQ ID NO: 42200 - DNA, 24 bp, Homo sapiens
cagtcctctcccaagtccacacag

SEQ ID NO: 42201 - DNA, 24 bp, Homo sapiens
agcaaggtttctgaagacaacggc

SEQ ID NO: 42202 - DNA, 24 bp, Homo sapiens
agaacctggcatcaccctgaagga

SEQ ID NO: 42203 - DNA, 24 bp, Homo sapiens
acccaagcaggttgtgtataaatt

SEQ ID NO: 42204 - DNA, 23 bp, Homo sapiens
gcagaagagactacacagcaggc

SEQ ID NO: 42205 - DNA, 23 bp, Homo sapiens
atgccattctcctgcctcagcct

SEQ ID NO: 42206 - DNA, 25 bp, Homo sapiens
gtcttcacaacacaatcacttactg

SEQ ID NO: 42207 - DNA, 23 bp, Homo sapiens
aggactttggcacccgagaagga

SEQ ID NO: 42208 - DNA, 23 bp, Homo sapiens
catcctgcgtggtggctgtcaag

SEQ ID NO: 42209 - DNA, 23 bp, Homo sapiens
tctgtgagcggcatggcatcaac

SEQ ID NO: 42210 - DNA, 24 bp, Homo sapiens
agaagatccgatcagctaccaagc

SEQ ID NO: 42211 - DNA, 24 bp, Homo sapiens
ctggagttctggctggcctgtgag

SEQ ID NO: 42212 - DNA, 24 bp, Homo sapiens
acgctttcctgaagacagagttca

SEQ ID NO: 42213 - DNA, 24 bp, Homo sapiens
aaatatttaaggcctctgacattg

SEQ ID NO: 42214 - DNA, 24 bp, Homo sapiens
gaaatatttaaggcctctgacatt

SEQ ID NO: 42215 - DNA, 24 bp, Homo sapiens
tgaaatatttaaggcctctgacat

SEQ ID NO: 42216 - DNA, 24 bp, Homo sapiens
tttctttgcagacttatgtgcaca

SEQ ID NO: 42217 - DNA, 24 bp, Homo sapiens
atttctttgcagacttatgtgcac

SEQ ID NO: 42218 - DNA, 24 bp, Homo sapiens
tatttctttgcagacttatgtgca

SEQ ID NO: 42219 - DNA, 24 bp, Homo sapiens
atttaatttagggaaatcctcatt

SEQ ID NO: 42220 - DNA, 24 bp, Homo sapiens
catttaatttagggaaatcctcat

SEQ ID NO: 42221 - DNA, 24 bp, Homo sapiens
acatttaatttagggaaatcctca

SEQ ID NO: 42222 - DNA, 24 bp, Homo sapiens
atttttgatagattgcaaaggtcg

SEQ ID NO: 42223 - DNA, 24 bp, Homo sapiens
catttttgatagattgcaaaggtc

SEQ ID NO: 42224 - DNA, 24 bp, Homo sapiens
tcatttttgatagattgcaaaggt

SEQ ID NO: 42225 - DNA, 25 bp, Homo sapiens
tgatgactctaccctaatgtcctgc

SEQ ID NO: 42226 - DNA, 25 bp, Homo sapiens
tctgatggagctgaactaatctgag

SEQ ID NO: 42227 - DNA, 25 bp, Homo sapiens
attcaagtgccactaaagtatgcct

SEQ ID NO: 42228 - DNA, 23 bp, Homo sapiens
gacagcagcaccactccagcctc

SEQ ID NO: 42229 - DNA, 24 bp, Homo sapiens
ccttgcctgtatcctcatctgtgt

SEQ ID NO: 42230 - DNA, 23 bp, Homo sapiens
cacgactccagaggctccacgac

SEQ ID NO: 42231 - DNA, 24 bp, Homo sapiens
gaggttggcaggccctctccgcat

SEQ ID NO: 42232 - DNA, 24 bp, Homo sapiens
tgaggttggcaggccctctccgca

SEQ ID NO: 42233 - DNA, 24 bp, Homo sapiens
atgaggttggcaggccctctccgc

SEQ ID NO: 42234 - DNA, 24 bp, Homo sapiens
gcaagaccctgacatatccgctgg

SEQ ID NO: 42235 - DNA, 23 bp, Homo sapiens
aagaagcggctacaggttggagg

SEQ ID NO: 42236 - DNA, 23 bp, Homo sapiens
atgaacaggacagccagccagcg

SEQ ID NO: 42237 - DNA, 24 bp, Homo sapiens
tctcttttcaagtaagtattattc

SEQ ID NO: 42238 - DNA, 24 bp, Homo sapiens
ttctcttttcaagtaagtattatt

SEQ ID NO: 42239 - DNA, 24 bp, Homo sapiens
attctcttttcaagtaagtattat

SEQ ID NO: 42240 - DNA, 24 bp, Homo sapiens
actctactcctgtaagtatagatg

SEQ ID NO: 42241 - DNA, 24 bp, Homo sapiens
cactctactcctgtaagtatagat

SEQ ID NO: 42242 - DNA, 24 bp, Homo sapiens
acactctactcctgtaagtataga

SEQ ID NO: 42243 - DNA, 23 bp, Homo sapiens
tagtgctgctgctgtggctgctg

SEQ ID NO: 42244 - DNA, 25 bp, Homo sapiens
cgttctgggtctgtcttgggtattc

SEQ ID NO: 42245 - DNA, 24 bp, Homo sapiens
tgagaccaccagcttggaggactg

SEQ ID NO: 42246 - DNA, 24 bp, Homo sapiens
ccagaagcagcagcaccagggaaa

SEQ ID NO: 42247 - DNA, 24 bp, Homo sapiens
tctctcttgtatgagggctttgag

SEQ ID NO: 42248 - DNA, 24 bp, Homo sapiens
aagccaggacgagttaccaaccag

SEQ ID NO: 42249 - DNA, 24 bp, Homo sapiens
aggttatgattcagaggaggagga

SEQ ID NO: 42250 - DNA, 24 bp, Homo sapiens
tgagttacgatgagaagcggcagc

SEQ ID NO: 42251 - DNA, 24 bp, Homo sapiens
acactcaagccatccacacttaga

SEQ ID NO: 42252 - DNA, 24 bp, Homo sapiens
tctgattttaggtaagtgaaagtg

SEQ ID NO: 42253 - DNA, 24 bp, Homo sapiens
gtctgattttaggtaagtgaaagt

SEQ ID NO: 42254 - DNA, 24 bp, Homo sapiens
agtctgattttaggtaagtgaaag

SEQ ID NO: 42255 - DNA, 24 bp, Homo sapiens
aacttttaaagatttttgcactga

SEQ ID NO: 42256 - DNA, 24 bp, Homo sapiens
gaacttttaaagatttttgcactg

SEQ ID NO: 42257 - DNA, 24 bp, Homo sapiens
agaacttttaaagatttttgcact

SEQ ID NO: 42258 - DNA, 24 bp, Homo sapiens
acattcctgggctggaagtagcag

SEQ ID NO: 42259 - DNA, 24 bp, Homo sapiens
gacattcctgggctggaagtagca

SEQ ID NO: 42260 - DNA, 24 bp, Homo sapiens
ggacattcctgggctggaagtagc

SEQ ID NO: 42261 - DNA, 24 bp, Homo sapiens
aagctcaacaggttatttttattt

SEQ ID NO: 42262 - DNA, 24 bp, Homo sapiens
caagctcaacaggttatttttatt

SEQ ID NO: 42263 - DNA, 24 bp, Homo sapiens
tcaagctcaacaggttatttttat

SEQ ID NO: 42264 - DNA, 24 bp, Homo sapiens
ttatctttcaggaaagcaaaatag

SEQ ID NO: 42265 - DNA, 24 bp, Homo sapiens
tttatctttcaggaaagcaaaata

SEQ ID NO: 42266 - DNA, 24 bp, Homo sapiens
ttttatctttcaggaaagcaaaat

SEQ ID NO: 42267 - DNA, 23 bp, Homo sapiens
gtggtagcagcagcagccaacaa

SEQ ID NO: 42268 - DNA, 23 bp, Homo sapiens
ggttgcctgtctcctgctccgaa

SEQ ID NO: 42269 - DNA, 24 bp, Homo sapiens
gcctaagcagcactctgaatgtgg

SEQ ID NO: 42270 - DNA, 24 bp, Homo sapiens
tatcattccagggaatgtgaaaaa

SEQ ID NO: 42271 - DNA, 24 bp, Homo sapiens
atatcattccagggaatgtgaaaa

SEQ ID NO: 42272 - DNA, 24 bp, Homo sapiens
gatatcattccagggaatgtgaaa

SEQ ID NO: 42273 - DNA, 24 bp, Homo sapiens
tttttcattaggaaaaatacctcg

SEQ ID NO: 42274 - DNA, 24 bp, Homo sapiens
gtttttcattaggaaaaatacctc

SEQ ID NO: 42275 - DNA, 24 bp, Homo sapiens
tgtttttcattaggaaaaatacct

SEQ ID NO: 42276 - DNA, 23 bp, Homo sapiens
cacagccacagcctcctcgcctc

SEQ ID NO: 42277 - DNA, 24 bp, Homo sapiens
acttgcgtctcttactgcgagtcg

SEQ ID NO: 42278 - DNA, 23 bp, Homo sapiens
ttcggcacaactttcctgtcggc

SEQ ID NO: 42279 - DNA, 24 bp, Homo sapiens
tttttgaagaggaagattttcagt

SEQ ID NO: 42280 - DNA, 24 bp, Homo sapiens
gtttttgaagaggaagattttcag

SEQ ID NO: 42281 - DNA, 24 bp, Homo sapiens
tgtttttgaagaggaagattttca

SEQ ID NO: 42282 - DNA, 24 bp, Homo sapiens
tgatgaaggaggtacatttgtaac

SEQ ID NO: 42283 - DNA, 24 bp, Homo sapiens
ctgatgaaggaggtacatttgtaa

SEQ ID NO: 42284 - DNA, 24 bp, Homo sapiens
cctgatgaaggaggtacatttgta

SEQ ID NO: 42285 - DNA, 24 bp, Homo sapiens
gctgagccagaaggatctcttgag

SEQ ID NO: 42286 - DNA, 24 bp, Homo sapiens
acagcctgggcaacatagcaagac

SEQ ID NO: 42287 - DNA, 25 bp, Homo sapiens
aatgcctgtattcccagcacattgg

SEQ ID NO: 42288 - DNA, 24 bp, Homo sapiens
ctgtttaacaagtatgtattaaac

SEQ ID NO: 42289 - DNA, 24 bp, Homo sapiens
tctgtttaacaagtatgtattaaa

SEQ ID NO: 42290 - DNA, 24 bp, Homo sapiens
ttctgtttaacaagtatgtattaa

SEQ ID NO: 42291 - DNA, 24 bp, Homo sapiens
tctccttcggttgtctgtctgcca

SEQ ID NO: 42292 - DNA, 24 bp, Homo sapiens
catactcgcactcacactcgctcc

SEQ ID NO: 42293 - DNA, 24 bp, Homo sapiens
cagaaggcagaggttgtggtgagc

SEQ ID NO: 42294 - DNA, 25 bp, Homo sapiens
tgtcttgaagatggtctctggtctc

SEQ ID NO: 42295 - DNA, 23 bp, Homo sapiens
aacttgctcctgcctcactgcct

SEQ ID NO: 42296 - DNA, 25 bp, Homo sapiens
acaatgcctggaaggtggaatctgg

SEQ ID NO: 42297 - DNA, 23 bp, Homo sapiens
cggagtccagcagtacacagcca

SEQ ID NO: 42298 - DNA, 23 bp, Homo sapiens
cagcagcagcagcgagaaggtcc

SEQ ID NO: 42299 - DNA, 23 bp, Homo sapiens
cgcagatgttcctacccttcggc

SEQ ID NO: 42300 - DNA, 23 bp, Homo sapiens
cagcagcagcagcgagaaggtcc

SEQ ID NO: 42301 - DNA, 23 bp, Homo sapiens
cgcagatgttcctacccttcggc

SEQ ID NO: 42302 - DNA, 25 bp, Homo sapiens
taccaaccagagcaagtgtttcggc

SEQ ID NO: 42303 - DNA, 24 bp, Homo sapiens
gcttctgagggaggaggacaacaa

SEQ ID NO: 42304 - DNA, 24 bp, Homo sapiens
tcctgtcgggagaaggctcagaag

SEQ ID NO: 42305 - DNA, 23 bp, Homo sapiens
ctccccgccccgctgccgagatg

SEQ ID NO: 42306 - DNA, 25 bp, Homo sapiens
ggctcggattcttggtctcctagat

SEQ ID NO: 42307 - DNA, 23 bp, Homo sapiens
ctacctgcctgcccacctgacag

SEQ ID NO: 42308 - DNA, 23 bp, Homo sapiens
cctccggtgtgaccacgtcctcc

SEQ ID NO: 42309 - DNA, 24 bp, Homo sapiens
aagtcacctaagttgctggattat

SEQ ID NO: 42310 - DNA, 24 bp, Homo sapiens
aaagtcacctaagttgctggatta

SEQ ID NO: 42311 - DNA, 24 bp, Homo sapiens
aaaagtcacctaagttgctggatt

SEQ ID NO: 42312 - DNA, 24 bp, Homo sapiens
agaaaattgaggatcatatccaga

SEQ ID NO: 42313 - DNA, 24 bp, Homo sapiens
aagaaaattgaggatcatatccag

SEQ ID NO: 42314 - DNA, 24 bp, Homo sapiens
aaagaaaattgaggatcatatcca

SEQ ID NO: 42315 - DNA, 24 bp, Homo sapiens
acgaccttcggatgccggaaggtc

SEQ ID NO: 42316 - DNA, 24 bp, Homo sapiens
tacgaccttcggatgccggaaggt

SEQ ID NO: 42317 - DNA, 24 bp, Homo sapiens
atacgaccttcggatgccggaagg

SEQ ID NO: 42318 - DNA, 24 bp, Homo sapiens
ttctttcacagaccctacagcttg

SEQ ID NO: 42319 - DNA, 24 bp, Homo sapiens
cttctttcacagaccctacagctt

SEQ ID NO: 42320 - DNA, 24 bp, Homo sapiens
tcttctttcacagaccctacagct

SEQ ID NO: 42321 - DNA, 24 bp, Homo sapiens
aaagaataactgtgagtatttaat

SEQ ID NO: 42322 - DNA, 24 bp, Homo sapiens
gaaagaataactgtgagtatttaa

SEQ ID NO: 42323 - DNA, 24 bp, Homo sapiens
tgaaagaataactgtgagtattta

SEQ ID NO: 42324 - DNA, 24 bp, Homo sapiens
caggaacagcggcagcagcagagt

SEQ ID NO: 42325 - DNA, 24 bp, Homo sapiens
tacagcagcagcattagcaacggc

SEQ ID NO: 42326 - DNA, 24 bp, Homo sapiens
acaacgagaccagcggcacttatg

SEQ ID NO: 42327 - DNA, 23 bp, Homo sapiens
gaccgcaccagccgaaaccgatg

SEQ ID NO: 42328 - DNA, 23 bp, Homo sapiens
gccgcatgtccaagaagcagagg

SEQ ID NO: 42329 - DNA, 23 bp, Homo sapiens
ggcaacagcagcaacaggaacca

SEQ ID NO: 42330 - DNA, 24 bp, Homo sapiens
tttctacttaggtaattgctctaa

SEQ ID NO: 42331 - DNA, 24 bp, Homo sapiens
ctttctacttaggtaattgctcta

SEQ ID NO: 42332 - DNA, 24 bp, Homo sapiens
actttctacttaggtaattgctct

SEQ ID NO: 42333 - DNA, 24 bp, Homo sapiens
tatattattagatgatttttggat

SEQ ID NO: 42334 - DNA, 24 bp, Homo sapiens
ttatattattagatgatttttgga

SEQ ID NO: 42335 - DNA, 24 bp, Homo sapiens
tttatattattagatgatttttgg

SEQ ID NO: 42336 - DNA, 24 bp, Homo sapiens
gctgcctatggatttctgtggtgc

SEQ ID NO: 42337 - DNA, 24 bp, Homo sapiens
tctgccattggtgaagtgatgaag

SEQ ID NO: 42338 - DNA, 24 bp, Homo sapiens
aatccatcagctactcctccaatt

SEQ ID NO: 42339 - DNA, 24 bp, Homo sapiens
tctgaacaaagatgtttgtatctg

SEQ ID NO: 42340 - DNA, 24 bp, Homo sapiens
ttctgaacaaagatgtttgtatct

SEQ ID NO: 42341 - DNA, 24 bp, Homo sapiens
cttctgaacaaagatgtttgtatc

SEQ ID NO: 42342 - DNA, 24 bp, Homo sapiens
tcttaaacatgaaacaacaaacaa

SEQ ID NO: 42343 - DNA, 24 bp, Homo sapiens
atcttaaacatgaaacaacaaaca

SEQ ID NO: 42344 - DNA, 24 bp, Homo sapiens
tatcttaaacatgaaacaacaaac

SEQ ID NO: 42345 - DNA, 24 bp, Homo sapiens
aaagacggaaggagagtagttatc

SEQ ID NO: 42346 - DNA, 24 bp, Homo sapiens
gaaagacggaaggagagtagttat

SEQ ID NO: 42347 - DNA, 24 bp, Homo sapiens
tgaaagacggaaggagagtagtta

SEQ ID NO: 42348 - DNA, 25 bp, Homo sapiens
gtcaccctgtggtagaaagccttcg

SEQ ID NO: 42349 - DNA, 25 bp, Homo sapiens
gccgattatctgcacctggacgtaa

SEQ ID NO: 42350 - DNA, 23 bp, Homo sapiens
ccgagtgcctccggatgctagac

SEQ ID NO: 42351 - DNA, 23 bp, Homo sapiens
ggctgaagtgcagtggcacagtc

SEQ ID NO: 42352 - DNA, 24 bp, Homo sapiens
cctcggcacggacacctgggcttc

SEQ ID NO: 42353 - DNA, 24 bp, Homo sapiens
cataagaggagccaccggcaccgg

SEQ ID NO: 42354 - DNA, 24 bp, Homo sapiens
cttcctgggctacaaggcgggcat

SEQ ID NO: 42355 - DNA, 24 bp, Homo sapiens
tgtccttgtaggttgaaaagaaaa

SEQ ID NO: 42356 - DNA, 24 bp, Homo sapiens
gtgtccttgtaggttgaaaagaaa

SEQ ID NO: 42357 - DNA, 24 bp, Homo sapiens
tgtgtccttgtaggttgaaaagaa

SEQ ID NO: 42358 - DNA, 25 bp, Homo sapiens
gctctacgagatccacaaggagttc

SEQ ID NO: 42359 - DNA, 23 bp, Homo sapiens
aagccgctgccaccacctctcag

SEQ ID NO: 42360 - DNA, 24 bp, Homo sapiens
ggagacttacctgagccacctgga

SEQ ID NO: 42361 - DNA, 23 bp, Homo sapiens
gtggtctcgctggctcaggagtg

SEQ ID NO: 42362 - DNA, 25 bp, Homo sapiens
tctgatgttcggatgtgttcggagt

SEQ ID NO: 42363 - DNA, 24 bp, Homo sapiens
tcaagtatgaagccgaccctcacg

SEQ ID NO: 42364 - DNA, 24 bp, Homo sapiens
gcagaccttcgcaacttccttcca

SEQ ID NO: 42365 - DNA, 23 bp, Homo sapiens
atcgtggtctcgctggctcagga

SEQ ID NO: 42366 - DNA, 25 bp, Homo sapiens
tctgatgttcggatgtgttcggagt

SEQ ID NO: 42367 - DNA, 24 bp, Homo sapiens
ctttctttcagctttggcttctcg

SEQ ID NO: 42368 - DNA, 24 bp, Homo sapiens
cctttctttcagctttggcttctc

SEQ ID NO: 42369 - DNA, 24 bp, Homo sapiens
acctttctttcagctttggcttct

SEQ ID NO: 42370 - DNA, 24 bp, Homo sapiens
aagcagcgtcattacttagcaccg

SEQ ID NO: 42371 - DNA, 24 bp, Homo sapiens
aagtgagacctgctgctaggagag

SEQ ID NO: 42372 - DNA, 23 bp, Homo sapiens
ctgacagcacccagcaaccacac

SEQ ID NO: 42373 - DNA, 24 bp, Homo sapiens
cccctcgtcctcctaaaatgctgg

SEQ ID NO: 42374 - DNA, 24 bp, Homo sapiens
ccaggctggtctcgaactcctgac

SEQ ID NO: 42375 - DNA, 24 bp, Homo sapiens
aggcatgagccatcacaccggccc

SEQ ID NO: 42376 - DNA, 24 bp, Homo sapiens
tgtgatggtgaagaggaagcggac

SEQ ID NO: 42377 - DNA, 24 bp, Homo sapiens
ctggaggtgatgtcaatggctggc

SEQ ID NO: 42378 - DNA, 24 bp, Homo sapiens
gagggcaagggtcactgtcttcac

SEQ ID NO: 42379 - DNA, 24 bp, Homo sapiens
cacctgcttcagttgtcctccaca

SEQ ID NO: 42380 - DNA, 24 bp, Homo sapiens
gctggtgacttcgtacctgctcag

SEQ ID NO: 42381 - DNA, 24 bp, Homo sapiens
agatggagtctcgctctgttgccc

SEQ ID NO: 42382 - DNA, 24 bp, Homo sapiens
gacactgaatctgcctacaccttg

SEQ ID NO: 42383 - DNA, 24 bp, Homo sapiens
gacttcccagcctccagaactgtg

SEQ ID NO: 42384 - DNA, 24 bp, Homo sapiens
gcagcattcaagataccatcctgg

SEQ ID NO: 42385 - DNA, 24 bp, Homo sapiens
agaagagaaaggtatataattatg

SEQ ID NO: 42386 - DNA, 24 bp, Homo sapiens
aagaagagaaaggtatataattat

SEQ ID NO: 42387 - DNA, 24 bp, Homo sapiens
taagaagagaaaggtatataatta

SEQ ID NO: 42388 - DNA, 24 bp, Homo sapiens
aaggctgcgaggttgtggtgtctg

SEQ ID NO: 42389 - DNA, 24 bp, Homo sapiens
tgctatggtgtgctgcggttcatc

SEQ ID NO: 42390 - DNA, 24 bp, Homo sapiens
ggctttccagagggcagtgtagag

SEQ ID NO: 42391 - DNA, 24 bp, Homo sapiens
gtaactggcagccaaggaggtttc

SEQ ID NO: 42392 - DNA, 24 bp, Homo sapiens
ggtaactggcagccaaggaggttt

SEQ ID NO: 42393 - DNA, 24 bp, Homo sapiens
gggtaactggcagccaaggaggtt

SEQ ID NO: 42394 - DNA, 25 bp, Homo sapiens
gtgaaggagggctttgagaaggcag

SEQ ID NO: 42395 - DNA, 25 bp, Homo sapiens
gagacatcttggcagaagtgaatca

SEQ ID NO: 42396 - DNA, 25 bp, Homo sapiens
tctacctgatcctggacttcctgcg

SEQ ID NO: 42397 - DNA, 24 bp, Homo sapiens
gaaatttataggtatatgatgatg

SEQ ID NO: 42398 - DNA, 24 bp, Homo sapiens
tgaaatttataggtatatgatgat

SEQ ID NO: 42399 - DNA, 24 bp, Homo sapiens
ttgaaatttataggtatatgatga

SEQ ID NO: 42400 - DNA, 24 bp, Homo sapiens
agacacccaaggaggctattgagg

SEQ ID NO: 42401 - DNA, 24 bp, Homo sapiens
gcggtactacaagaacatcggtct

SEQ ID NO: 42402 - DNA, 24 bp, Homo sapiens
gctgggagaaactggcaaggagaa

SEQ ID NO: 42403 - DNA, 24 bp, Homo sapiens
gaggaccattgtcatccgccgaga

SEQ ID NO: 42404 - DNA, 24 bp, Homo sapiens
tgcactacatccgcaagtacaacc

SEQ ID NO: 42405 - DNA, 24 bp, Homo sapiens
tctctggcgtggtgaccaagatga

SEQ ID NO: 42406 - DNA, 24 bp, Homo sapiens
ttgtcatccgccgagactatctgc

SEQ ID NO: 42407 - DNA, 24 bp, Homo sapiens
ccgcaagtacaaccgcttcgagaa

SEQ ID NO: 42408 - DNA, 24 bp, Homo sapiens
ttgtcatccgccgagactatctgc

SEQ ID NO: 42409 - DNA, 24 bp, Homo sapiens
ccgcaagtacaaccgcttcgagaa

SEQ ID NO: 42410 - DNA, 24 bp, Homo sapiens
gacatcgtcacagtgggcgagtgc

SEQ ID NO: 42411 - DNA, 24 bp, Homo sapiens
atcctccccagcgagcagctgatg

SEQ ID NO: 42412 - DNA, 24 bp, Homo sapiens
catcctccccagcgagcagctgat

SEQ ID NO: 42413 - DNA, 24 bp, Homo sapiens
gcatcctccccagcgagcagctga

SEQ ID NO: 42414 - DNA, 24 bp, Homo sapiens
gccattctaacacccgttgctacc

SEQ ID NO: 42415 - DNA, 23 bp, Homo sapiens
gccacccgcctctccagacccct

SEQ ID NO: 42416 - DNA, 23 bp, Homo sapiens
ggaaaaaccctaagtgcctgtga

SEQ ID NO: 42417 - DNA, 24 bp, Homo sapiens
aagtgctgggattacaggcgtgag

SEQ ID NO: 42418 - DNA, 24 bp, Homo sapiens
cctcaatgtcatctgcccacttgg

SEQ ID NO: 42419 - DNA, 24 bp, Homo sapiens
cgaccggcccaaagttaaccttct

SEQ ID NO: 42420 - DNA, 23 bp, Homo sapiens
gagatgaggtcttgctctgtggc

SEQ ID NO: 42421 - DNA, 25 bp, Homo sapiens
accacaagaacgcaaagaaggagga

SEQ ID NO: 42422 - DNA, 25 bp, Homo sapiens
gggctagtctcaaactcctgggcta

SEQ ID NO: 42423 - DNA, 24 bp, Homo sapiens
gttcggaccaggtatgtgctctgc

SEQ ID NO: 42424 - DNA, 24 bp, Homo sapiens
agttcggaccaggtatgtgctctg

SEQ ID NO: 42425 - DNA, 24 bp, Homo sapiens
aagttcggaccaggtatgtgctct

SEQ ID NO: 42426 - DNA, 24 bp, Homo sapiens
aggtggcagggctgaggcaacttc

SEQ ID NO: 42427 - DNA, 24 bp, Homo sapiens
gaggtggcagggctgaggcaactt

SEQ ID NO: 42428 - DNA, 24 bp, Homo sapiens
ggaggtggcagggctgaggcaact

SEQ ID NO: 42429 - DNA, 24 bp, Homo sapiens
gttcttttcagacatatgaagatc

SEQ ID NO: 42430 - DNA, 24 bp, Homo sapiens
tgttcttttcagacatatgaagat

SEQ ID NO: 42431 - DNA, 24 bp, Homo sapiens
ttgttcttttcagacatatgaaga

SEQ ID NO: 42432 - DNA, 24 bp, Homo sapiens
ccagttgttggtggtcctcgttac

SEQ ID NO: 42433 - DNA, 24 bp, Homo sapiens
cccagttgttggtggtcctcgtta

SEQ ID NO: 42434 - DNA, 24 bp, Homo sapiens
ccccagttgttggtggtcctcgtt

SEQ ID NO: 42435 - DNA, 24 bp, Homo sapiens
atgaaaaaaagagaatccaagttc

SEQ ID NO: 42436 - DNA, 24 bp, Homo sapiens
aatgaaaaaaagagaatccaagtt

SEQ ID NO: 42437 - DNA, 24 bp, Homo sapiens
aaatgaaaaaaagagaatccaagt

SEQ ID NO: 42438 - DNA, 23 bp, Homo sapiens
gagaacgaagcggtgacgccgaa

SEQ ID NO: 42439 - DNA, 23 bp, Homo sapiens
gggtcccagtggctcaggcaccg

SEQ ID NO: 42440 - DNA, 23 bp, Homo sapiens
caggacgagctgctgccgctggc

SEQ ID NO: 42441 - DNA, 24 bp, Homo sapiens
gctgcgggcaggctggaatgagct

SEQ ID NO: 42442 - DNA, 24 bp, Homo sapiens
tgctgcgggcaggctggaatgagc

SEQ ID NO: 42443 - DNA, 24 bp, Homo sapiens
ctgctgcgggcaggctggaatgag

SEQ ID NO: 42444 - DNA, 24 bp, Homo sapiens
cccagattaactcaacagtgtcac

SEQ ID NO: 42445 - DNA, 24 bp, Homo sapiens
cctgaagatgtgaagccaccagtc

SEQ ID NO: 42446 - DNA, 24 bp, Homo sapiens
agggcttcttcaaacgcaccatcc

SEQ ID NO: 42447 - DNA, 24 bp, Homo sapiens
cagagatgcatctaatccaagccg

SEQ ID NO: 42448 - DNA, 24 bp, Homo sapiens
ccagagatgcatctaatccaagcc

SEQ ID NO: 42449 - DNA, 24 bp, Homo sapiens
accagagatgcatctaatccaagc

SEQ ID NO: 42450 - DNA, 24 bp, Homo sapiens
ttgaggaccgcatgatagatgacc

SEQ ID NO: 42451 - DNA, 24 bp, Homo sapiens
gagcaggaggaggaggaggaagag

SEQ ID NO: 42452 - DNA, 24 bp, Homo sapiens
agagcaaactggatgaggattacc

SEQ ID NO: 42453 - DNA, 24 bp, Homo sapiens
ttgctgtcttcgtcaacggcgaga

SEQ ID NO: 42454 - DNA, 24 bp, Homo sapiens
aatgtggtggtgcggctgctcatc

SEQ ID NO: 42455 - DNA, 24 bp, Homo sapiens
cactttggtgaggaaccgcctgaa

SEQ ID NO: 42456 - DNA, 24 bp, Homo sapiens
aatgtggtggtgcggctgctcatc

SEQ ID NO: 42457 - DNA, 24 bp, Homo sapiens
cactttggtgaggaaccgcctgaa

SEQ ID NO: 42458 - DNA, 24 bp, Homo sapiens
tgtccttctatgccgccttgatcg

SEQ ID NO: 42459 - DNA, 24 bp, Homo sapiens
ttaaattgcaggtaatcagaacaa

SEQ ID NO: 42460 - DNA, 24 bp, Homo sapiens
gttaaattgcaggtaatcagaaca

SEQ ID NO: 42461 - DNA, 24 bp, Homo sapiens
agttaaattgcaggtaatcagaac

SEQ ID NO: 42462 - DNA, 24 bp, Homo sapiens
aaatgatctaggtttctgtggacg

SEQ ID NO: 42463 - DNA, 24 bp, Homo sapiens
caaatgatctaggtttctgtggac

SEQ ID NO: 42464 - DNA, 24 bp, Homo sapiens
acaaatgatctaggtttctgtgga

SEQ ID NO: 42465 - DNA, 24 bp, Homo sapiens
aatgtgattaagttctccacagac

SEQ ID NO: 42466 - DNA, 24 bp, Homo sapiens
caatgtgattaagttctccacaga

SEQ ID NO: 42467 - DNA, 24 bp, Homo sapiens
tcaatgtgattaagttctccacag

SEQ ID NO: 42468 - DNA, 24 bp, Homo sapiens
aatgtgattaagtgaagagaagga

SEQ ID NO: 42469 - DNA, 24 bp, Homo sapiens
caatgtgattaagtgaagagaagg

SEQ ID NO: 42470 - DNA, 24 bp, Homo sapiens
tcaatgtgattaagtgaagagaag

SEQ ID NO: 42471 - DNA, 24 bp, Homo sapiens
tgttcattcagttacctcctccta

SEQ ID NO: 42472 - DNA, 24 bp, Homo sapiens
ttgttcattcagttacctcctcct

SEQ ID NO: 42473 - DNA, 24 bp, Homo sapiens
tttgttcattcagttacctcctcc

SEQ ID NO: 42474 - DNA, 24 bp, Homo sapiens
taattgagaaggtggcaagttatg

SEQ ID NO: 42475 - DNA, 24 bp, Homo sapiens
ttaattgagaaggtggcaagttat

SEQ ID NO: 42476 - DNA, 24 bp, Homo sapiens
cttaattgagaaggtggcaagtta

SEQ ID NO: 42477 - DNA, 24 bp, Homo sapiens
gctctggtcacggcaattctggag

SEQ ID NO: 42478 - DNA, 24 bp, Homo sapiens
tgctctggtcacggcaattctgga

SEQ ID NO: 42479 - DNA, 24 bp, Homo sapiens
ctgctctggtcacggcaattctgg

SEQ ID NO: 42480 - DNA, 24 bp, Homo sapiens
gcttccacgactttgaccacaggg

SEQ ID NO: 42481 - DNA, 24 bp, Homo sapiens
cgctaccattctgactttaaccgc

SEQ ID NO: 42482 - DNA, 24 bp, Homo sapiens
gaggagcgtgagcggctggagatt

SEQ ID NO: 42483 - DNA, 24 bp, Homo sapiens
aaagggtcgcagcagttgtggtag

SEQ ID NO: 42484 - DNA, 24 bp, Homo sapiens
ccaagcccagaagccagagatagc

SEQ ID NO: 42485 - DNA, 24 bp, Homo sapiens
gatggcgagaggacggactgtgag

SEQ ID NO: 42486 - DNA, 24 bp, Homo sapiens
ggttcaagcgattctcctgcctca

SEQ ID NO: 42487 - DNA, 24 bp, Homo sapiens
ctctacaaccattgagcctaccgc

SEQ ID NO: 42488 - DNA, 24 bp, Homo sapiens
cgaatgttgtgtagccttcaccgc

SEQ ID NO: 42489 - DNA, 24 bp, Homo sapiens
caggcaggcagacagtgagatgac

SEQ ID NO: 42490 - DNA, 24 bp, Homo sapiens
gctacacgcagacggtggacatct

SEQ ID NO: 42491 - DNA, 24 bp, Homo sapiens
aggcaagacgctgttcaagggcag

SEQ ID NO: 42492 - DNA, 24 bp, Homo sapiens
gcaacctggctgtgaacgaagact

SEQ ID NO: 42493 - DNA, 24 bp, Homo sapiens
caggcaggcagacagtgagatgac

SEQ ID NO: 42494 - DNA, 24 bp, Homo sapiens
gctacacgcagacggtggacatct

SEQ ID NO: 42495 - DNA, 24 bp, Homo sapiens
caggcaggcagacagtgagatgac

SEQ ID NO: 42496 - DNA, 24 bp, Homo sapiens
ggctcccgaggtcatcttgaattg

SEQ ID NO: 42497 - DNA, 24 bp, Homo sapiens
cagacggccgtggcacccctagct

SEQ ID NO: 42498 - DNA, 24 bp, Homo sapiens
ccagacggccgtggcacccctagc

SEQ ID NO: 42499 - DNA, 24 bp, Homo sapiens
gccagacggccgtggcacccctag

SEQ ID NO: 42500 - DNA, 24 bp, Homo sapiens
gcagcgagcagccctctatatcct

SEQ ID NO: 42501 - DNA, 24 bp, Homo sapiens
cgaggcacggcaggtgaaggctag

SEQ ID NO: 42502 - DNA, 24 bp, Homo sapiens
ctgagcccagcccagcctccttcc

SEQ ID NO: 42503 - DNA, 24 bp, Homo sapiens
cgaggcacggcaggtgaaggctag

SEQ ID NO: 42504 - DNA, 24 bp, Homo sapiens
gctgaaagcatgtgtcccaggctg

SEQ ID NO: 42505 - DNA, 24 bp, Homo sapiens
ctgagcccagcccagcctccttcc

SEQ ID NO: 42506 - DNA, 24 bp, Homo sapiens
catttctacagaattataaggctg

SEQ ID NO: 42507 - DNA, 24 bp, Homo sapiens
tcatttctacagaattataaggct

SEQ ID NO: 42508 - DNA, 24 bp, Homo sapiens
ttcatttctacagaattataaggc

SEQ ID NO: 42509 - DNA, 24 bp, Homo sapiens
gagcaacagcagccgcaagacatt

SEQ ID NO: 42510 - DNA, 24 bp, Homo sapiens
tcatttctactacagtggcggagc

SEQ ID NO: 42511 - DNA, 24 bp, Homo sapiens
ccccccttccccacgcaaccccag

SEQ ID NO: 42512 - DNA, 24 bp, Homo sapiens
tacactttacaatttcctctcctg

SEQ ID NO: 42513 - DNA, 24 bp, Homo sapiens
ttacactttacaatttcctctcct

SEQ ID NO: 42514 - DNA, 24 bp, Homo sapiens
tttacactttacaatttcctctcc

SEQ ID NO: 42515 - DNA, 24 bp, Homo sapiens
atcacattatgaaagaagacatag

SEQ ID NO: 42516 - DNA, 24 bp, Homo sapiens
aatcacattatgaaagaagacata

SEQ ID NO: 42517 - DNA, 24 bp, Homo sapiens
caatcacattatgaaagaagacat

SEQ ID NO: 42518 - DNA, 24 bp, Homo sapiens
gagtacgctagacttgtctgacct

SEQ ID NO: 42519 - DNA, 24 bp, Homo sapiens
gaccaccgtgcccaccacaagttt

SEQ ID NO: 42520 - DNA, 24 bp, Homo sapiens
tgctgatcctcataattcccgacg

SEQ ID NO: 42521 - DNA, 24 bp, Homo sapiens
aggcagctcagcaggcagcaacgg

SEQ ID NO: 42522 - DNA, 24 bp, Homo sapiens
gaggcagctcagcaggcagcaacg

SEQ ID NO: 42523 - DNA, 24 bp, Homo sapiens
ggaggcagctcagcaggcagcaac

SEQ ID NO: 42524 - DNA, 24 bp, Homo sapiens
gcaaggggattctgtttagaagat

SEQ ID NO: 42525 - DNA, 24 bp, Homo sapiens
acaccttcacaggaatatatactt

SEQ ID NO: 42526 - DNA, 24 bp, Homo sapiens
cttcgggatccatggaactggctc

SEQ ID NO: 42527 - DNA, 24 bp, Homo sapiens
cattccggctgctccgagttttca

SEQ ID NO: 42528 - DNA, 24 bp, Homo sapiens
tcattccggctgctccgagttttc

SEQ ID NO: 42529 - DNA, 24 bp, Homo sapiens
atcattccggctgctccgagtttt

SEQ ID NO: 42530 - DNA, 24 bp, Homo sapiens
tgactgtgttctgtctaagcgtgt

SEQ ID NO: 42531 - DNA, 24 bp, Homo sapiens
acattcagagttctccgagcattg

SEQ ID NO: 42532 - DNA, 24 bp, Homo sapiens
agagtttgtggacctgggcaatgt

SEQ ID NO: 42533 - DNA, 24 bp, Homo sapiens
agaaaaagaagataagtattcttt

SEQ ID NO: 42534 - DNA, 24 bp, Homo sapiens
cagaaaaagaagataagtattctt

SEQ ID NO: 42535 - DNA, 24 bp, Homo sapiens
gcagaaaaagaagataagtattct

SEQ ID NO: 42536 - DNA, 24 bp, Homo sapiens
aagaatgtagagtaagtaggaata

SEQ ID NO: 42537 - DNA, 24 bp, Homo sapiens
aaagaatgtagagtaagtaggaat

SEQ ID NO: 42538 - DNA, 24 bp, Homo sapiens
caaagaatgtagagtaagtaggaa

SEQ ID NO: 42539 - DNA, 24 bp, Homo sapiens
ccgctggctcaatgtcaaggtcaa

SEQ ID NO: 42540 - DNA, 24 bp, Homo sapiens
acaacaagtctgagtgcgagagcc

SEQ ID NO: 42541 - DNA, 24 bp, Homo sapiens
gcatcaacaccaccacctctgaga

SEQ ID NO: 42542 - DNA, 24 bp, Homo sapiens
ggagaaggaggagcagccgcagta

SEQ ID NO: 42543 - DNA, 24 bp, Homo sapiens
ccgctggctcaatgtcaaggtcaa

SEQ ID NO: 42544 - DNA, 24 bp, Homo sapiens
acaacaagtctgagtgcgagagcc

SEQ ID NO: 42545 - DNA, 24 bp, Homo sapiens
agaaaaaaaatgtgagtattaatt

SEQ ID NO: 42546 - DNA, 24 bp, Homo sapiens
aagaaaaaaaatgtgagtattaat

SEQ ID NO: 42547 - DNA, 24 bp, Homo sapiens
aagaaaaaaaatgtgagtattaat

SEQ ID NO: 42548 - DNA, 24 bp, Homo sapiens
ccagtattagaggttattataaga

SEQ ID NO: 42549 - DNA, 24 bp, Homo sapiens
accagtattagaggttattataag

SEQ ID NO: 42550 - DNA, 24 bp, Homo sapiens
gaccagtattagaggttattataa

SEQ ID NO: 42551 - DNA, 24 bp, Homo sapiens
acataaggaaggttttcattggaa

SEQ ID NO: 42552 - DNA, 24 bp, Homo sapiens
gacataaggaaggttttcattgga

SEQ ID NO: 42553 - DNA, 24 bp, Homo sapiens
agacataaggaaggttttcattgg

SEQ ID NO: 42554 - DNA, 24 bp, Homo sapiens
aaggaatgagggtcgttgtgaatg

SEQ ID NO: 42555 - DNA, 24 bp, Homo sapiens
gaaggaatgagggtcgttgtgaat

SEQ ID NO: 42556 - DNA, 24 bp, Homo sapiens
tgaaggaatgagggtcgttgtgaa

SEQ ID NO: 42557 - DNA, 24 bp, Homo sapiens
ctcgaccagggaacaaaatccaag

SEQ ID NO: 42558 - DNA, 24 bp, Homo sapiens
cctcgaccagggaacaaaatccaa

SEQ ID NO: 42559 - DNA, 24 bp, Homo sapiens
tcctcgaccagggaacaaaatcca

SEQ ID NO: 42560 - DNA, 24 bp, Homo sapiens
gcaagaggcttctgtgtaggagaa

SEQ ID NO: 42561 - DNA, 24 bp, Homo sapiens
tgacccgtggaactggctggattt

SEQ ID NO: 42562 - DNA, 24 bp, Homo sapiens
gggctttgatccagtcagtgaaga

SEQ ID NO: 42563 - DNA, 24 bp, Homo sapiens
aagacttgctaccgtatcgtggag

SEQ ID NO: 42564 - DNA, 24 bp, Homo sapiens
tgctggagtacactgacagggtct

SEQ ID NO: 42565 - DNA, 24 bp, Homo sapiens
ggtgctggctggacttcctcattg

SEQ ID NO: 42566 - DNA, 24 bp, Homo sapiens
tgctggagtacactgacagggtct

SEQ ID NO: 42567 - DNA, 24 bp, Homo sapiens
ggtgctggctggacttcctcattg

SEQ ID NO: 42568 - DNA, 24 bp, Homo sapiens
aagtctcacagcgaagattctgga

SEQ ID NO: 42569 - DNA, 24 bp, Homo sapiens
agaaaaaaaagaacaagttccagg

SEQ ID NO: 42570 - DNA, 24 bp, Homo sapiens
cagaaaaaaaagaacaagttccag

SEQ ID NO: 42571 - DNA, 24 bp, Homo sapiens
acagaaaaaaaagaacaagttcca

SEQ ID NO: 42572 - DNA, 24 bp, Homo sapiens
tccacagtccactccagggctcat

SEQ ID NO: 42573 - DNA, 24 bp, Homo sapiens
gagttccaccgctcctaccgagag

SEQ ID NO: 42574 - DNA, 24 bp, Homo sapiens
gcaacaacaccaccatccacggcg

SEQ ID NO: 42575 - DNA, 24 bp, Homo sapiens
agaagtacctgctgaagggcctgc

SEQ ID NO: 42576 - DNA, 24 bp, Homo sapiens
ctgctggtgtggtactgcgacaac

SEQ ID NO: 42577 - DNA, 24 bp, Homo sapiens
gttcctgctcaccctgctcttcgc

SEQ ID NO: 42578 - DNA, 24 bp, Homo sapiens
ggtgatgctgatgctgtgcctgaa

SEQ ID NO: 42579 - DNA, 24 bp, Homo sapiens
cttatcgcagatgaagccaccagg

SEQ ID NO: 42580 - DNA, 24 bp, Homo sapiens
tctggttacagtatggcgttgtgc

SEQ ID NO: 42581 - DNA, 24 bp, Homo sapiens
ccagaggctccatcctgcttcaga

SEQ ID NO: 42582 - DNA, 24 bp, Homo sapiens
atggacgggagaatggaagcagcc

SEQ ID NO: 42583 - DNA, 24 bp, Homo sapiens
caccatcagcaccaccaccaccac

SEQ ID NO: 42584 - DNA, 24 bp, Homo sapiens
actagaaaagaagaattttctccc

SEQ ID NO: 42585 - DNA, 24 bp, Homo sapiens
aactagaaaagaagaattttctcc

SEQ ID NO: 42586 - DNA, 24 bp, Homo sapiens
gaactagaaaagaagaattttctc

SEQ ID NO: 42587 - DNA, 24 bp, Homo sapiens
ggaaaaatatggaacaaaaattga

SEQ ID NO: 42588 - DNA, 24 bp, Homo sapiens
tggaaaaatatggaacaaaaattg

SEQ ID NO: 42589 - DNA, 24 bp, Homo sapiens
atggaaaaatatggaacaaaaatt

SEQ ID NO: 42590 - DNA, 24 bp, Homo sapiens
gggaagcgcagcgagcaggacgca

SEQ ID NO: 42591 - DNA, 24 bp, Homo sapiens
ggggaagcgcagcgagcaggacgc

SEQ ID NO: 42592 - DNA, 24 bp, Homo sapiens
tggggaagcgcagcgagcaggacg

SEQ ID NO: 42593 - DNA, 24 bp, Homo sapiens
tgtgctttccggaggctccactgc

SEQ ID NO: 42594 - DNA, 24 bp, Homo sapiens
ctgtgctttccggaggctccactg

SEQ ID NO: 42595 - DNA, 24 bp, Homo sapiens
tctgtgctttccggaggctccact

SEQ ID NO: 42596 - DNA, 24 bp, Homo sapiens
ttcgtgtccttcatccttcgtgcc

SEQ ID NO: 42597 - DNA, 24 bp, Homo sapiens
cgccgtgctcttctcctcagatga

SEQ ID NO: 42598 - DNA, 24 bp, Homo sapiens
aactactcctggctgctggtggaa

SEQ ID NO: 42599 - DNA, 24 bp, Homo sapiens
ggttcaagcgattctcctgcctca

SEQ ID NO: 42600 - DNA, 24 bp, Homo sapiens
gagtcgtagagattgtcaggtcca

SEQ ID NO: 42601 - DNA, 24 bp, Homo sapiens
ttctttccacacccacagtctcgc

SEQ ID NO: 42602 - DNA, 24 bp, Homo sapiens
tgaagtagcagcaacagcaccagc

SEQ ID NO: 42603 - DNA, 24 bp, Homo sapiens
tgttcagcatttctactccttcca

SEQ ID NO: 42604 - DNA, 24 bp, Homo sapiens
ctatagccttggctgtgatattgt

SEQ ID NO: 42605 - DNA, 24 bp, Homo sapiens
gttggtgctgctgctgctgctgac

SEQ ID NO: 42606 - DNA, 24 bp, Homo sapiens
accactatgagcctcctgtccagc

SEQ ID NO: 42607 - DNA, 24 bp, Homo sapiens
atcttcgctcctccaatctccgct

SEQ ID NO: 42608 - DNA, 24 bp, Homo sapiens
cattgtggaaggtaagtggagaag

SEQ ID NO: 42609 - DNA, 24 bp, Homo sapiens
acattgtggaaggtaagtggagaa

SEQ ID NO: 42610 - DNA, 24 bp, Homo sapiens
tacattgtggaaggtaagtggaga

SEQ ID NO: 42611 - DNA, 24 bp, Homo sapiens
gccatgcacagcctgggtctggct

SEQ ID NO: 42612 - DNA, 24 bp, Homo sapiens
ggccatgcacagcctgggtctggc

SEQ ID NO: 42613 - DNA, 24 bp, Homo sapiens
tggccatgcacagcctgggtctgg

SEQ ID NO: 42614 - DNA, 24 bp, Homo sapiens
agacagctcagaggaccgcgcttt

SEQ ID NO: 42615 - DNA, 24 bp, Homo sapiens
gagacagctcagaggaccgcgctt

SEQ ID NO: 42616 - DNA, 24 bp, Homo sapiens
ggagacagctcagaggaccgcgct

SEQ ID NO: 42617 - DNA, 23 bp, Homo sapiens
gctctgcccgctatgctttctcc

SEQ ID NO: 42618 - DNA, 23 bp, Homo sapiens
cagctctatgccgcctaccttgg

SEQ ID NO: 42619 - DNA, 23 bp, Homo sapiens
aatgtgatgctggctggctgtcg

SEQ ID NO: 42620 - DNA, 24 bp, Homo sapiens
ggtccatccatcgcataagagcaa

SEQ ID NO: 42621 - DNA, 24 bp, Homo sapiens
acaccttatatggagtctctgcga

SEQ ID NO: 42622 - DNA, 24 bp, Homo sapiens
ctcaagtttggaaagggcgggcag

SEQ ID NO: 42623 - DNA, 24 bp, Homo sapiens
gaccctcaaagatgaccttgcttc

SEQ ID NO: 42624 - DNA, 24 bp, Homo sapiens
agaccctcaaagatgaccttgctt

SEQ ID NO: 42625 - DNA, 24 bp, Homo sapiens
aagaccctcaaagatgaccttgct

SEQ ID NO: 42626 - DNA, 24 bp, Homo sapiens
cagcctccagaagccctgcccttc

SEQ ID NO: 42627 - DNA, 24 bp, Homo sapiens
ccagcctccagaagccctgccctt

SEQ ID NO: 42628 - DNA, 24 bp, Homo sapiens
cccagcctccagaagccctgccct

SEQ ID NO: 42629 - DNA, 24 bp, Homo sapiens
aatatttttaggcagaatttatac

SEQ ID NO: 42630 - DNA, 24 bp, Homo sapiens
aaatatttttaggcagaatttata

SEQ ID NO: 42631 - DNA, 24 bp, Homo sapiens
aaaatatttttaggcagaatttat

SEQ ID NO: 42632 - DNA, 24 bp, Homo sapiens
agaaatcaaaggtaaagaagtaaa

SEQ ID NO: 42633 - DNA, 24 bp, Homo sapiens
cagaaatcaaaggtaaagaagtaa

SEQ ID NO: 42634 - DNA, 24 bp, Homo sapiens
acagaaatcaaaggtaaagaagta

SEQ ID NO: 42635 - DNA, 24 bp, Homo sapiens
atattaaacagattgtgcctctgc

SEQ ID NO: 42636 - DNA, 24 bp, Homo sapiens
tatattaaacagattgtgcctctg

SEQ ID NO: 42637 - DNA, 24 bp, Homo sapiens
ttatattaaacagattgtgcctct

SEQ ID NO: 42638 - DNA, 24 bp, Homo sapiens
ttgccaaatagatgatctgttaca

SEQ ID NO: 42639 - DNA, 24 bp, Homo sapiens
tttgccaaatagatgatctgttac

SEQ ID NO: 42640 - DNA, 24 bp, Homo sapiens
ttttgccaaatagatgatctgtta

SEQ ID NO: 42641 - DNA, 24 bp, Homo sapiens
agataattaagtgccttgcaaatt

SEQ ID NO: 42642 - DNA, 24 bp, Homo sapiens
cagataattaagtgccttgcaaat

SEQ ID NO: 42643 - DNA, 24 bp, Homo sapiens
tcagataattaagtgccttgcaaa

SEQ ID NO: 42644 - DNA, 24 bp, Homo sapiens
gtctcagacaggtcagagtgagcc

SEQ ID NO: 42645 - DNA, 24 bp, Homo sapiens
tgtctcagacaggtcagagtgagc

SEQ ID NO: 42646 - DNA, 24 bp, Homo sapiens
ctgtctcagacaggtcagagtgag

SEQ ID NO: 42647 - DNA, 24 bp, Homo sapiens
cccacaatcagaataaaaagaaaa

SEQ ID NO: 42648 - DNA, 24 bp, Homo sapiens
tcccacaatcagaataaaaagaaa

SEQ ID NO: 42649 - DNA, 24 bp, Homo sapiens
ctcccacaatcagaataaaaagaa

SEQ ID NO: 42650 - DNA, 24 bp, Homo sapiens
gaccaactttggtacatttatgtt

SEQ ID NO: 42651 - DNA, 24 bp, Homo sapiens
cgaccaactttggtacatttatgt

SEQ ID NO: 42652 - DNA, 24 bp, Homo sapiens
tcgaccaactttggtacatttatg

SEQ ID NO: 42653 - DNA, 25 bp, Homo sapiens
cgacatttacacagacatgggaagg

SEQ ID NO: 42654 - DNA, 25 bp, Homo sapiens
gcagccaagcaccacattactattg

SEQ ID NO: 42655 - DNA, 25 bp, Homo sapiens
tgaacttgtagacattgagaaggct

SEQ ID NO: 42656 - DNA, 24 bp, Homo sapiens
catcaatcagggttacagagccat

SEQ ID NO: 42657 - DNA, 24 bp, Homo sapiens
tcatcaatcagggttacagagcca

SEQ ID NO: 42658 - DNA, 24 bp, Homo sapiens
ctcatcaatcagggttacagagcc

SEQ ID NO: 42659 - DNA, 24 bp, Homo sapiens
tgggattacagcagtgtatgtatg

SEQ ID NO: 42660 - DNA, 24 bp, Homo sapiens
ctgggattacagcagtgtatgtat

SEQ ID NO: 42661 - DNA, 24 bp, Homo sapiens
gctgggattacagcagtgtatgta

SEQ ID NO: 42662 - DNA, 24 bp, Homo sapiens
tttcatttcagtgcaagcagctaa

SEQ ID NO: 42663 - DNA, 24 bp, Homo sapiens
ttttcatttcagtgcaagcagcta

SEQ ID NO: 42664 - DNA, 24 bp, Homo sapiens
tttttcatttcagtgcaagcagct

SEQ ID NO: 42665 - DNA, 24 bp, Homo sapiens
ctgtaaggcagccgtgtctgtgtt

SEQ ID NO: 42666 - DNA, 24 bp, Homo sapiens
gatgccaccaccgtcagacattgt

SEQ ID NO: 42667 - DNA, 24 bp, Homo sapiens
agtttgtgatgggtggtcgttgcc

SEQ ID NO: 42668 - DNA, 24 bp, Homo sapiens
tttattttcagatgatttgaaagg

SEQ ID NO: 42669 - DNA, 24 bp, Homo sapiens
ctttattttcagatgatttgaaag

SEQ ID NO: 42670 - DNA, 24 bp, Homo sapiens
actttattttcagatgatttgaaa

SEQ ID NO: 42671 - DNA, 24 bp, Homo sapiens
tatcatttcgggtaatttaatttt

SEQ ID NO: 42672 - DNA, 24 bp, Homo sapiens
atatcatttcgggtaatttaattt

SEQ ID NO: 42673 - DNA, 24 bp, Homo sapiens
aatatcatttcgggtaatttaatt

SEQ ID NO: 42674 - DNA, 24 bp, Homo sapiens
tactcccaaagcaaaattctgtgg

SEQ ID NO: 42675 - DNA, 24 bp, Homo sapiens
ttactcccaaagcaaaattctgtg

SEQ ID NO: 42676 - DNA, 24 bp, Homo sapiens
tttactcccaaagcaaaattctgt

SEQ ID NO: 42677 - DNA, 24 bp, Homo sapiens
gccagcaggaggcccagaaccgga

SEQ ID NO: 42678 - DNA, 24 bp, Homo sapiens
agccagcaggaggcccagaaccgg

SEQ ID NO: 42679 - DNA, 24 bp, Homo sapiens
cagccagcaggaggcccagaaccg

SEQ ID NO: 42680 - DNA, 23 bp, Homo sapiens
gatggagtcggtgctgggtgctg

SEQ ID NO: 42681 - DNA, 23 bp, Homo sapiens
tcctgagcatcctgaaccgcaag

SEQ ID NO: 42682 - DNA, 23 bp, Homo sapiens
gcaatgaccagttcgcaccgtcc

SEQ ID NO: 42683 - DNA, 24 bp, Homo sapiens
gtaaaaactaggtgttttgtttta

SEQ ID NO: 42684 - DNA, 24 bp, Homo sapiens
ggtaaaaactaggtgttttgtttt

SEQ ID NO: 42685 - DNA, 24 bp, Homo sapiens
aggtaaaaactaggtgttttgttt

SEQ ID NO: 42686 - DNA, 24 bp, Homo sapiens
tgacatcacaggctttcatagaaa

SEQ ID NO: 42687 - DNA, 24 bp, Homo sapiens
ctgacatcacaggctttcatagaa

SEQ ID NO: 42688 - DNA, 24 bp, Homo sapiens
gctgacatcacaggctttcataga

SEQ ID NO: 42689 - DNA, 24 bp, Homo sapiens
aaatgtgcaaagtgatgatgacca

SEQ ID NO: 42690 - DNA, 24 bp, Homo sapiens
gaaatgtgcaaagtgatgatgacc

SEQ ID NO: 42691 - DNA, 24 bp, Homo sapiens
agaaatgtgcaaagtgatgatgac

SEQ ID NO: 42692 - DNA, 25 bp, Homo sapiens
ggacacagccagaccatatcagaca

SEQ ID NO: 42693 - DNA, 25 bp, Homo sapiens
cgtgctgctgataaagacataccca

SEQ ID NO: 42694 - DNA, 25 bp, Homo sapiens
caatcgtgatggaaggtgaaagaca

SEQ ID NO: 42695 - DNA, 23 bp, Homo sapiens
cctgctcggctgtctcggtggtc

SEQ ID NO: 42696 - DNA, 23 bp, Homo sapiens
cggggtcccggaggggagtgcgc

SEQ ID NO: 42697 - DNA, 23 bp, Homo sapiens
ccttgcctctgtgggaccctgtg

SEQ ID NO: 42698 - DNA, 24 bp, Homo sapiens
ccattcgcctgtgctgagtcttcc

SEQ ID NO: 42699 - DNA, 23 bp, Homo sapiens
ggctcccgtccactccactgctg

SEQ ID NO: 42700 - DNA, 23 bp, Homo sapiens
ggctcccgtccactccactgctg

SEQ ID NO: 42701 - DNA, 24 bp, Homo sapiens
ccattcgcctgtgctgagtcttcc

SEQ ID NO: 42702 - DNA, 23 bp, Homo sapiens
cttgcctctgtgggaccctgtgg

SEQ ID NO: 42703 - DNA, 24 bp, Homo sapiens
cagaaaagcagcaatatgaatgct

SEQ ID NO: 42704 - DNA, 24 bp, Homo sapiens
tcagaaaagcagcaatatgaatgc

SEQ ID NO: 42705 - DNA, 24 bp, Homo sapiens
atcagaaaagcagcaatatgaatg

SEQ ID NO: 42706 - DNA, 23 bp, Homo sapiens
ttcctgctgcgggagacggtgag

SEQ ID NO: 42707 - DNA, 23 bp, Homo sapiens
ggcgtcagataccctggaggccc

SEQ ID NO: 42708 - DNA, 23 bp, Homo sapiens
atggctggcggtcagatgcagag

SEQ ID NO: 42709 - DNA, 23 bp, Homo sapiens
ctccaggtgaaccgcctccagga

SEQ ID NO: 42710 - DNA, 23 bp, Homo sapiens
agaggcaggtccaggtggcagag

SEQ ID NO: 42711 - DNA, 23 bp, Homo sapiens
cagaagatgctggacggtgcctc

SEQ ID NO: 42712 - DNA, 23 bp, Homo sapiens
cgccaccaccacctccatcatct

SEQ ID NO: 42713 - DNA, 25 bp, Homo sapiens
ctgacaaggagaacactgatgacca

SEQ ID NO: 42714 - DNA, 23 bp, Homo sapiens
catcgtctcaggagcagtccgac

SEQ ID NO: 42715 - DNA, 24 bp, Homo sapiens
gaaatcaggagactgcagaattcc

SEQ ID NO: 42716 - DNA, 24 bp, Homo sapiens
ggaaatcaggagactgcagaattc

SEQ ID NO: 42717 - DNA, 24 bp, Homo sapiens
aggaaatcaggagactgcagaatt

SEQ ID NO: 42718 - DNA, 24 bp, Homo sapiens
agggctagtaggtagggttagtag

SEQ ID NO: 42719 - DNA, 24 bp, Homo sapiens
tagggctagtaggtagggttagta

SEQ ID NO: 42720 - DNA, 24 bp, Homo sapiens
gtagggctagtaggtagggttagt

SEQ ID NO: 42721 - DNA, 24 bp, Homo sapiens
agtaggtagggttcgtaggtaggg

SEQ ID NO: 42722 - DNA, 24 bp, Homo sapiens
tagtaggtagggttcgtaggtagg

SEQ ID NO: 42723 - DNA, 24 bp, Homo sapiens
ttagtaggtagggttcgtaggtag

SEQ ID NO: 42724 - DNA, 24 bp, Homo sapiens
ggacgagtggaaccgagactgccc

SEQ ID NO: 42725 - DNA, 24 bp, Homo sapiens
cccctcgccaccccgtgtcccagg

SEQ ID NO: 42726 - DNA, 24 bp, Homo sapiens
ccccggaaccggcggtcgagctac

SEQ ID NO: 42727 - DNA, 24 bp, Homo sapiens
agtaggtagggctagtaggtaggg

SEQ ID NO: 42728 - DNA, 24 bp, Homo sapiens
tagtaggtagggctagtaggtagg

SEQ ID NO: 42729 - DNA, 24 bp, Homo sapiens
ttagtaggtagggctagtaggtag

SEQ ID NO: 42730 - DNA, 24 bp, Homo sapiens
gaaaatgcaagaataaacttacct

SEQ ID NO: 42731 - DNA, 24 bp, Homo sapiens
agaaaatgcaagaataaacttacc

SEQ ID NO: 42732 - DNA, 24 bp, Homo sapiens
aagaaaatgcaagaataaacttac

SEQ ID NO: 42733 - DNA, 23 bp, Homo sapiens
agtgagaagttctgcgtggatgc

SEQ ID NO: 42734 - DNA, 23 bp, Homo sapiens
gtgtggcgtgctcctgcgatgac

SEQ ID NO: 42735 - DNA, 23 bp, Homo sapiens
ggacattgagccaggtgaggagc

SEQ ID NO: 42736 - DNA, 24 bp, Homo sapiens
tgaacgtgaatacacacaagttca

SEQ ID NO: 42737 - DNA, 24 bp, Homo sapiens
ttgaacgtgaatacacacaagttc

SEQ ID NO: 42738 - DNA, 24 bp, Homo sapiens
tttgaacgtgaatacacacaagtt

SEQ ID NO: 42739 - DNA, 23 bp, Homo sapiens
gctagagccgcacgagatacctt

SEQ ID NO: 42740 - DNA, 23 bp, Homo sapiens
ggagggcgtgtggaatcagcatt

SEQ ID NO: 42741 - DNA, 23 bp, Homo sapiens
cagcaacgggcatcagagaagca

SEQ ID NO: 42742 - DNA, 24 bp, Homo sapiens
gaagaagcacggcgacaagaagtt

SEQ ID NO: 42743 - DNA, 25 bp, Homo sapiens
agcaagatgttctaccgcaaggacg

SEQ ID NO: 42744 - DNA, 23 bp, Homo sapiens
ctggaaggagtgcggcgagtgaa

SEQ ID NO: 42745 - DNA, 25 bp, Homo sapiens
tccagaccctgtgctcttaactccc

SEQ ID NO: 42746 - DNA, 25 bp, Homo sapiens
gatagagccaggatttgaaagcagg

SEQ ID NO: 42747 - DNA, 23 bp, Homo sapiens
catcaagaacagaatcctatgaa

SEQ ID NO: 42748 - DNA, 24 bp, Homo sapiens
cttagaaatgggtaaggaaaaaaa

SEQ ID NO: 42749 - DNA, 24 bp, Homo sapiens
acttagaaatgggtaaggaaaaaa

SEQ ID NO: 42750 - DNA, 24 bp, Homo sapiens
tacttagaaatgggtaaggaaaaa

SEQ ID NO: 42751 - DNA, 24 bp, Homo sapiens
tttatttgcagaatgacatgaatt

SEQ ID NO: 42752 - DNA, 24 bp, Homo sapiens
ctttatttgcagaatgacatgaat

SEQ ID NO: 42753 - DNA, 24 bp, Homo sapiens
gctttatttgcagaatgacatgaa

SEQ ID NO: 42754 - DNA, 24 bp, Homo sapiens
catctgctgctgctgtctgtatca

SEQ ID NO: 42755 - DNA, 23 bp, Homo sapiens
ttggagttgtggtgtaccgcctg

SEQ ID NO: 42756 - DNA, 25 bp, Homo sapiens
tcgtcttcttgtttctgtctcagga

SEQ ID NO: 42757 - DNA, 25 bp, Homo sapiens
cgggttgagatccacagagctaaac

SEQ ID NO: 42758 - DNA, 25 bp, Homo sapiens
tgtctccagatattgccagatgtcc

SEQ ID NO: 42759 - DNA, 23 bp, Homo sapiens
aactgacattgcgtttccgttgt

SEQ ID NO: 42760 - DNA, 24 bp, Homo sapiens
ctgcagtggagttgtttaagaatg

SEQ ID NO: 42761 - DNA, 24 bp, Homo sapiens
actgcagtggagttgtttaagaat

SEQ ID NO: 42762 - DNA, 24 bp, Homo sapiens
cactgcagtggagttgtttaagaa

SEQ ID NO: 42763 - DNA, 24 bp, Homo sapiens
ttaacttacaggttgcttataatg

SEQ ID NO: 42764 - DNA, 24 bp, Homo sapiens
gttaacttacaggttgcttataat

SEQ ID NO: 42765 - DNA, 24 bp, Homo sapiens
ggttaacttacaggttgcttataa

SEQ ID NO: 42766 - DNA, 25 bp, Homo sapiens
ttacattcaagacaagagcagaagc

SEQ ID NO: 42767 - DNA, 23 bp, Homo sapiens
gcctggtcatgctgtggtggatc

SEQ ID NO: 42768 - DNA, 23 bp, Homo sapiens
gaggtcgaggtgcagttcatggc

SEQ ID NO: 42769 - DNA, 23 bp, Homo sapiens
gcctggtcatgctgtggtggatc

SEQ ID NO: 42770 - DNA, 23 bp, Homo sapiens
gaggtcgaggtgcagttcatggc

SEQ ID NO: 42771 - DNA, 25 bp, Homo sapiens
gctgccaaacgagggattctttcat

SEQ ID NO: 42772 - DNA, 25 bp, Homo sapiens
cggagtcgcagttatagcaggagtc

SEQ ID NO: 42773 - DNA, 25 bp, Homo sapiens
gaggcttcgtgagagggacagagat

SEQ ID NO: 42774 - DNA, 24 bp, Homo sapiens
agcagaagcagaacacgaagcagg

SEQ ID NO: 42775 - DNA, 23 bp, Homo sapiens
gagcaggacagggacccatcact

SEQ ID NO: 42776 - DNA, 23 bp, Homo sapiens
cgggatgcttgtctgggcgactc

SEQ ID NO: 42777 - DNA, 23 bp, Homo sapiens
gggtctacatcagcctctctgcg

SEQ ID NO: 42778 - DNA, 23 bp, Homo sapiens
tgctgctgctggctgaggacatc

SEQ ID NO: 42779 - DNA, 25 bp, Homo sapiens
ccgtgaggtcaggtgtcatcattga

SEQ ID NO: 42780 - DNA, 24 bp, Homo sapiens
caagacatctacgccgtggtgacc

SEQ ID NO: 42781 - DNA, 24 bp, Homo sapiens
aagtgaacacggagaatctgctgc

SEQ ID NO: 42782 - DNA, 23 bp, Homo sapiens
cgtgggttggtgtggctgaagac

SEQ ID NO: 42783 - DNA, 23 bp, Homo sapiens
ctgttctcagcagctactggtcc

SEQ ID NO: 42784 - DNA, 23 bp, Homo sapiens
acaagggcgactccaaggaaacg

SEQ ID NO: 42785 - DNA, 25 bp, Homo sapiens
tcatctggattacgtggctgtatgt

SEQ ID NO: 42786 - DNA, 25 bp, Homo sapiens
aactagaggcttgtggaatgagacg

SEQ ID NO: 42787 - DNA, 24 bp, Homo sapiens
ctttctctcaggatttatggttgg

SEQ ID NO: 42788 - DNA, 24 bp, Homo sapiens
tctttctctcaggatttatggttg

SEQ ID NO: 42789 - DNA, 24 bp, Homo sapiens
atctttctctcaggatttatggtt

SEQ ID NO: 42790 - DNA, 24 bp, Homo sapiens
aggaaaaacaggtaactatcttag

SEQ ID NO: 42791 - DNA, 24 bp, Homo sapiens
caggaaaaacaggtaactatctta

SEQ ID NO: 42792 - DNA, 24 bp, Homo sapiens
acaggaaaaacaggtaactatctt

SEQ ID NO: 42793 - DNA, 24 bp, Homo sapiens
ccgctgcttggatggtgccattca

SEQ ID NO: 42794 - DNA, 24 bp, Homo sapiens
accgctgcttggatggtgccattc

SEQ ID NO: 42795 - DNA, 24 bp, Homo sapiens
aaccgctgcttggatggtgccatt

SEQ ID NO: 42796 - DNA, 24 bp, Homo sapiens
ctaaaatagagtgagtgcctttca

SEQ ID NO: 42797 - DNA, 24 bp, Homo sapiens
actaaaatagagtgagtgcctttc

SEQ ID NO: 42798 - DNA, 24 bp, Homo sapiens
cactaaaatagagtgagtgccttt

SEQ ID NO: 42799 - DNA, 24 bp, Homo sapiens
cattttcttggggagtaagagtgc

SEQ ID NO: 42800 - DNA, 24 bp, Homo sapiens
acattttcttggggagtaagagtg

SEQ ID NO: 42801 - DNA, 24 bp, Homo sapiens
gacattttcttggggagtaagagt

SEQ ID NO: 42802 - DNA, 24 bp, Homo sapiens
cttccttggatgtaagttataaaa

SEQ ID NO: 42803 - DNA, 24 bp, Homo sapiens
acttccttggatgtaagttataaa

SEQ ID NO: 42804 - DNA, 24 bp, Homo sapiens
gacttccttggatgtaagttataa

SEQ ID NO: 42805 - DNA, 24 bp, Homo sapiens
aaaagaaaaaggtaagttttagag

SEQ ID NO: 42806 - DNA, 24 bp, Homo sapiens
aaaaagaaaaaggtaagttttaga

SEQ ID NO: 42807 - DNA, 24 bp, Homo sapiens
taaaaagaaaaaggtaagttttag

SEQ ID NO: 42808 - DNA, 24 bp, Homo sapiens
gacttagaaagaatctttaatgaa

SEQ ID NO: 42809 - DNA, 24 bp, Homo sapiens
agacttagaaagaatctttaatga

SEQ ID NO: 42810 - DNA, 24 bp, Homo sapiens
aagacttagaaagaatctttaatg

SEQ ID NO: 42811 - DNA, 23 bp, Homo sapiens
gctacggtcaccctgctggctac

SEQ ID NO: 42812 - DNA, 25 bp, Homo sapiens
gggaggagagagcggtgagtgatag

SEQ ID NO: 42813 - DNA, 25 bp, Homo sapiens
aaggtttactccatcatctccgtgc

SEQ ID NO: 42814 - DNA, 25 bp, Homo sapiens
ggttcaagtgattctcctgcctcgg

SEQ ID NO: 42815 - DNA, 25 bp, Homo sapiens
gctcttgccagtctgacagtgttct

SEQ ID NO: 42816 - DNA, 23 bp, Homo sapiens
tgctcagaggctggagtacggtg

SEQ ID NO: 42817 - DNA, 24 bp, Homo sapiens
tatctctacaggtatatgttaatt

SEQ ID NO: 42818 - DNA, 24 bp, Homo sapiens
gtatctctacaggtatatgttaat

SEQ ID NO: 42819 - DNA, 24 bp, Homo sapiens
ggtatctctacaggtatatgttaa

SEQ ID NO: 42820 - DNA, 23 bp, Homo sapiens
gctacgctgccacttcaatgccc

SEQ ID NO: 42821 - DNA, 23 bp, Homo sapiens
cgccacctctgactcggagcagc

SEQ ID NO: 42822 - DNA, 23 bp, Homo sapiens
gaggatgtgctgagcgtgttcgg

SEQ ID NO: 42823 - DNA, 23 bp, Homo sapiens
caggagcctcagccagcagcacc

SEQ ID NO: 42824 - DNA, 23 bp, Homo sapiens
ttctccgaagtcatgggcagtgc

SEQ ID NO: 42825 - DNA, 23 bp, Homo sapiens
gactgctgctggagcctggacac

SEQ ID NO: 42826 - DNA, 24 bp, Homo sapiens
ttgaaacgaaagtacgtattgcaa

SEQ ID NO: 42827 - DNA, 24 bp, Homo sapiens
attgaaacgaaagtacgtattgca

SEQ ID NO: 42828 - DNA, 24 bp, Homo sapiens
cattgaaacgaaagtacgtattgc

SEQ ID NO: 42829 - DNA, 24 bp, Homo sapiens
aacattgctcagggtcagtggtca

SEQ ID NO: 42830 - DNA, 24 bp, Homo sapiens
gcggattcagggcttgactcacac

SEQ ID NO: 42831 - DNA, 24 bp, Homo sapiens
ggtccacagccgcactcactccgc

SEQ ID NO: 42832 - DNA, 23 bp, Homo sapiens
gctactgctgttgctgccgctgg

SEQ ID NO: 42833 - DNA, 25 bp, Homo sapiens
cgccatctgttactgtgacctcttc

SEQ ID NO: 42834 - DNA, 24 bp, Homo sapiens
tgacttctgggacttctgcctcgg

SEQ ID NO: 42835 - DNA, 23 bp, Homo sapiens
caggagaacaggcagtggcagtg

SEQ ID NO: 42836 - DNA, 25 bp, Homo sapiens
ggaggtcgtatctatccagtcttgg

SEQ ID NO: 42837 - DNA, 23 bp, Homo sapiens
gatccagacatgatcaaagccat

SEQ ID NO: 42838 - DNA, 25 bp, Homo sapiens
acaatgacatctaccaggtcactcc

SEQ ID NO: 42839 - DNA, 23 bp, Homo sapiens
gccactgcccactgccccaacag

SEQ ID NO: 42840 - DNA, 23 bp, Homo sapiens
ctaccccttctcgggccgtgaac

SEQ ID NO: 42841 - DNA, 24 bp, Homo sapiens
tggagactcaggatggctactttt

SEQ ID NO: 42842 - DNA, 24 bp, Homo sapiens
ctggagactcaggatggctacttt

SEQ ID NO: 42843 - DNA, 24 bp, Homo sapiens
cctggagactcaggatggctactt

SEQ ID NO: 42844 - DNA, 24 bp, Homo sapiens
aagcaatgcagagattgagaattt

SEQ ID NO: 42845 - DNA, 24 bp, Homo sapiens
aaagcaatgcagagattgagaatt

SEQ ID NO: 42846 - DNA, 24 bp, Homo sapiens
gaaagcaatgcagagattgagaat

SEQ ID NO: 42847 - DNA, 24 bp, Homo sapiens
acagaaaccggagattgagaattt

SEQ ID NO: 42848 - DNA, 24 bp, Homo sapiens
gacagaaaccggagattgagaatt

SEQ ID NO: 42849 - DNA, 24 bp, Homo sapiens
agacagaaaccggagattgagaat

SEQ ID NO: 42850 - DNA, 23 bp, Homo sapiens
ccaccagcaccctcacacagttc

SEQ ID NO: 42851 - DNA, 23 bp, Homo sapiens
tggttattggcgtgctcatcggc

SEQ ID NO: 42852 - DNA, 23 bp, Homo sapiens
gccagcaaggtcttcaacaacac

SEQ ID NO: 42853 - DNA, 24 bp, Homo sapiens
gctcaaggagaagttgtgtccgaa

SEQ ID NO: 42854 - DNA, 24 bp, Homo sapiens
gggttcttggtctcgctgacttta

SEQ ID NO: 42855 - DNA, 24 bp, Homo sapiens
ttcttacaaatgagtcactatgtc

SEQ ID NO: 42856 - DNA, 24 bp, Homo sapiens
cctggtgaacgctagaatgggtac

SEQ ID NO: 42857 - DNA, 24 bp, Homo sapiens
gcctggtgaacgctagaatgggta

SEQ ID NO: 42858 - DNA, 24 bp, Homo sapiens
tgcctggtgaacgctagaatgggt

SEQ ID NO: 42859 - DNA, 24 bp, Homo sapiens
atgatgctgagagaatggtcaaga

SEQ ID NO: 42860 - DNA, 24 bp, Homo sapiens
tatgatgctgagagaatggtcaag

SEQ ID NO: 42861 - DNA, 24 bp, Homo sapiens
gtatgatgctgagagaatggtcaa

SEQ ID NO: 42862 - DNA, 23 bp, Homo sapiens
gacagcctgaccaaccgcacctt

SEQ ID NO: 42863 - DNA, 25 bp, Homo sapiens
aggaactagcactactcaagcagga

SEQ ID NO: 42864 - DNA, 24 bp, Homo sapiens
tagtcaccactgagcctgccatca

SEQ ID NO: 42865 - DNA, 25 bp, Homo sapiens
aggaactagcactactcaagcagga

SEQ ID NO: 42866 - DNA, 23 bp, Homo sapiens
gacagcctgaccaaccgcacctt

SEQ ID NO: 42867 - DNA, 25 bp, Homo sapiens
tggacgagatcgacataatcagcct

SEQ ID NO: 42868 - DNA, 24 bp, Homo sapiens
catttgtcaagcctctccttggca

SEQ ID NO: 42869 - DNA, 24 bp, Homo sapiens
tcatttgtcaagcctctccttggc

SEQ ID NO: 42870 - DNA, 24 bp, Homo sapiens
ttcatttgtcaagcctctccttgg

SEQ ID NO: 42871 - DNA, 24 bp, Homo sapiens
gagaagaaagacatggctgacagt

SEQ ID NO: 42872 - DNA, 24 bp, Homo sapiens
agagaagaaagacatggctgacag

SEQ ID NO: 42873 - DNA, 24 bp, Homo sapiens
aagagaagaaagacatggctgaca

SEQ ID NO: 42874 - DNA, 24 bp, Homo sapiens
tgtatttacagaaaatgacgaaga

SEQ ID NO: 42875 - DNA, 24 bp, Homo sapiens
ctgtatttacagaaaatgacgaag

SEQ ID NO: 42876 - DNA, 24 bp, Homo sapiens
ctgtatttacagaaaatgacgaag

SEQ ID NO: 42877 - DNA, 24 bp, Homo sapiens
ctggagactgctgttgctgttgct

SEQ ID NO: 42878 - DNA, 25 bp, Homo sapiens
tcgtcttacatctgctaactccact

SEQ ID NO: 42879 - DNA, 25 bp, Homo sapiens
ggagaagtcagatgacgaacaggtc

SEQ ID NO: 42880 - DNA, 23 bp, Homo sapiens
cggagcctctgcttggagttggg

SEQ ID NO: 42881 - DNA, 23 bp, Homo sapiens
ctgtgaccagcctccgcgcccag

SEQ ID NO: 42882 - DNA, 23 bp, Homo sapiens
gcaagcttggggccctcactgag

SEQ ID NO: 42883 - DNA, 24 bp, Homo sapiens
taatatttcagagtatctcctcaa

SEQ ID NO: 42884 - DNA, 24 bp, Homo sapiens
ataatatttcagagtatctcctca

SEQ ID NO: 42885 - DNA, 24 bp, Homo sapiens
tataatatttcagagtatctcctc

SEQ ID NO: 42886 - DNA, 23 bp, Homo sapiens
cgttgatggttccagcaagcctg

SEQ ID NO: 42887 - DNA, 23 bp, Homo sapiens
agcagcagcagcagcaacaacag

SEQ ID NO: 42888 - DNA, 24 bp, Homo sapiens
caacagcaacagcaacagcagcag

SEQ ID NO: 42889 - DNA, 23 bp, Homo sapiens
agcagcagcagcaacagcagcag

SEQ ID NO: 42890 - DNA, 23 bp, Homo sapiens
agcagcagcagcagcaacaacag

SEQ ID NO: 42891 - DNA, 23 bp, Homo sapiens
cgttgatggttccagcaagcctg

SEQ ID NO: 42892 - DNA, 24 bp, Homo sapiens
atgcaattgaggtaaaattgtgtt

SEQ ID NO: 42893 - DNA, 24 bp, Homo sapiens
aatgcaattgaggtaaaattgtgt

SEQ ID NO: 42894 - DNA, 24 bp, Homo sapiens
aaatgcaattgaggtaaaattgtg

SEQ ID NO: 42895 - DNA, 24 bp, Homo sapiens
cgccaaagagaggaaagttacagc

SEQ ID NO: 42896 - DNA, 24 bp, Homo sapiens
tcgtcaacgtgagatggaagaaca

SEQ ID NO: 42897 - DNA, 24 bp, Homo sapiens
cctcaactcaggtgtggtttcaga

SEQ ID NO: 42898 - DNA, 24 bp, Homo sapiens
gcctcaactcaggtgtggtttcag

SEQ ID NO: 42899 - DNA, 24 bp, Homo sapiens
agcctcaactcaggtgtggtttca

SEQ ID NO: 42900 - DNA, 24 bp, Homo sapiens
aacacttcaaaaacagaagaaagt

SEQ ID NO: 42901 - DNA, 24 bp, Homo sapiens
aaacacttcaaaaacagaagaaag

SEQ ID NO: 42902 - DNA, 24 bp, Homo sapiens
gaaacacttcaaaaacagaagaaa

SEQ ID NO: 42903 - DNA, 24 bp, Homo sapiens
aacacttcaaagtgagttttaaac

SEQ ID NO: 42904 - DNA, 24 bp, Homo sapiens
aaacacttcaaagtgagttttaaa

SEQ ID NO: 42905 - DNA, 24 bp, Homo sapiens
gaaacacttcaaagtgagttttaa

SEQ ID NO: 42906 - DNA, 23 bp, Homo sapiens
gctgcctaccctttcatctctgc

SEQ ID NO: 42907 - DNA, 23 bp, Homo sapiens
cccaggcaggcagtgcggagctg

SEQ ID NO: 42908 - DNA, 24 bp, Homo sapiens
gggggacagtggagccaagggagg

SEQ ID NO: 42909 - DNA, 24 bp, Homo sapiens
agggggacagtggagccaagggag

SEQ ID NO: 42910 - DNA, 24 bp, Homo sapiens
cagggggacagtggagccaaggga

SEQ ID NO: 42911 - DNA, 24 bp, Homo sapiens
ttctcagaaaaagttcagatcatt

SEQ ID NO: 42912 - DNA, 24 bp, Homo sapiens
attctcagaaaaagttcagatcat

SEQ ID NO: 42913 - DNA, 24 bp, Homo sapiens
cattctcagaaaaagttcagatca

SEQ ID NO: 42914 - DNA, 24 bp, Homo sapiens
ctgctgctgctcttcctcgcctcg

SEQ ID NO: 42915 - DNA, 24 bp, Homo sapiens
cgcgcccacgatgctgcagggccc

SEQ ID NO: 42916 - DNA, 24 bp, Homo sapiens
gctctgttttgttcattaattctg

SEQ ID NO: 42917 - DNA, 24 bp, Homo sapiens
ggctctgttttgttcattaattct

SEQ ID NO: 42918 - DNA, 24 bp, Homo sapiens
gggctctgttttgttcattaattc

SEQ ID NO: 42919 - DNA, 23 bp, Homo sapiens
ccagagcaagatccgccagagcc

SEQ ID NO: 42920 - DNA, 23 bp, Homo sapiens
cggtctcaggctacgtctccagg

SEQ ID NO: 42921 - DNA, 23 bp, Homo sapiens
ctccttggaagtgctggcgactc

SEQ ID NO: 42922 - DNA, 23 bp, Homo sapiens
ggcagcagtggaccaggcagatc

SEQ ID NO: 42923 - DNA, 23 bp, Homo sapiens
gtggagagcgggcagatcatgtg

SEQ ID NO: 42924 - DNA, 23 bp, Homo sapiens
aaccacgctgctggacgccatgt

SEQ ID NO: 42925 - DNA, 23 bp, Homo sapiens
ggcagcagtggaccaggcagatc

SEQ ID NO: 42926 - DNA, 23 bp, Homo sapiens
atgcctcctacagcgtcagccac

SEQ ID NO: 42927 - DNA, 25 bp, Homo sapiens
ggtctccaagtaaacagaggctccc

SEQ ID NO: 42928 - DNA, 25 bp, Homo sapiens
actgtgcctacatcatcatctacgg

SEQ ID NO: 42929 - DNA, 23 bp, Homo sapiens
tgtggctggtggtcttctgttgc

SEQ ID NO: 42930 - DNA, 25 bp, Homo sapiens
ctctacaactccttctacctcgccg

SEQ ID NO: 42931 - DNA, 25 bp, Homo sapiens
atcggtgctctcatccctttcaacg

SEQ ID NO: 42932 - DNA, 23 bp, Homo sapiens
acctgcccaccctcctcatccat

SEQ ID NO: 42933 - DNA, 24 bp, Homo sapiens
ctctccttcatggatacagccgcc

SEQ ID NO: 42934 - DNA, 24 bp, Homo sapiens
agtcgtagcagaagccgtagcaga

SEQ ID NO: 42935 - DNA, 24 bp, Homo sapiens
aggagaagcagaggatcaccacgc

SEQ ID NO: 42936 - DNA, 24 bp, Homo sapiens
ccttgctcctaacatctacattcc

SEQ ID NO: 42937 - DNA, 24 bp, Homo sapiens
actgctttctggagttcgctcacg

SEQ ID NO: 42938 - DNA, 24 bp, Homo sapiens
gcattctgagccatcccacatctg

SEQ ID NO: 42939 - DNA, 24 bp, Homo sapiens
gatgccttggacgccgacagtgaa

SEQ ID NO: 42940 - DNA, 23 bp, Homo sapiens
atgccgttgccatctgccactca

SEQ ID NO: 42941 - DNA, 25 bp, Homo sapiens
tggcgtaatcacaaggaacagagac

SEQ ID NO: 42942 - DNA, 23 bp, Homo sapiens
tgagcaacagtcacctcctccag

SEQ ID NO: 42943 - DNA, 23 bp, Homo sapiens
attccctctgcggtgcccctgac

SEQ ID NO: 42944 - DNA, 23 bp, Homo sapiens
ccgcagggacagcacgagcagcc

SEQ ID NO: 42945 - DNA, 23 bp, Homo sapiens
gcaagaagccaccctggctaaag

SEQ ID NO: 42946 - DNA, 25 bp, Homo sapiens
aactcctggactcaagagatcctcc

SEQ ID NO: 42947 - DNA, 24 bp, Homo sapiens
cagagtctcactatgtcgcccagg

SEQ ID NO: 42948 - DNA, 24 bp, Homo sapiens
atgacagttccatcagctctccaa

SEQ ID NO: 42949 - DNA, 24 bp, Homo sapiens
tggagctgctggtgctggagcaat

SEQ ID NO: 42950 - DNA, 24 bp, Homo sapiens
ttggagctgctggtgctggagcaa

SEQ ID NO: 42951 - DNA, 24 bp, Homo sapiens
cttggagctgctggtgctggagca

SEQ ID NO: 42952 - DNA, 25 bp, Homo sapiens
ggcttgtcttgaactcctggactca

SEQ ID NO: 42953 - DNA, 25 bp, Homo sapiens
cccaccattaccatctctcctttgt

SEQ ID NO: 42954 - DNA, 25 bp, Homo sapiens
attccagaagacagaggtttgagtg

SEQ ID NO: 42955 - DNA, 25 bp, Homo sapiens
aggcgtgagctattacacctgactt

SEQ ID NO: 42956 - DNA, 25 bp, Homo sapiens
ggcttgtcttgaactcctggactca

SEQ ID NO: 42957 - DNA, 25 bp, Homo sapiens
accatgacagttccatcagctctcc

SEQ ID NO: 42958 - DNA, 24 bp, Homo sapiens
aagacaagccaggttccagacgac

SEQ ID NO: 42959 - DNA, 24 bp, Homo sapiens
gtggagaatttgtcaagtcggtgc

SEQ ID NO: 42960 - DNA, 24 bp, Homo sapiens
acggcgagatggcagttacggttc

SEQ ID NO: 42961 - DNA, 24 bp, Homo sapiens
aacttaaactgcacacagagactc

SEQ ID NO: 42962 - DNA, 24 bp, Homo sapiens
aaacttaaactgcacacagagact

SEQ ID NO: 42963 - DNA, 24 bp, Homo sapiens
aaaacttaaactgcacacagagac

SEQ ID NO: 42964 - DNA, 23 bp, Homo sapiens
agcccaagagcacgaaccctgag

SEQ ID NO: 42965 - DNA, 25 bp, Homo sapiens
gccacctttgaggaaaccagggaag

SEQ ID NO: 42966 - DNA, 24 bp, Homo sapiens
cgtgcgtgtggcttacatgatcct

SEQ ID NO: 42967 - DNA, 24 bp, Homo sapiens
atgtctgtcagaattgtgaaaaat

SEQ ID NO: 42968 - DNA, 24 bp, Homo sapiens
aatgtctgtcagaattgtgaaaaa

SEQ ID NO: 42969 - DNA, 24 bp, Homo sapiens
gaatgtctgtcagaattgtgaaaa

SEQ ID NO: 42970 - DNA, 24 bp, Homo sapiens
aacatataaagggtgaatttgtga

SEQ ID NO: 42971 - DNA, 24 bp, Homo sapiens
aaacatataaagggtgaatttgtg

SEQ ID NO: 42972 - DNA, 24 bp, Homo sapiens
taaacatataaagggtgaatttgt

SEQ ID NO: 42973 - DNA, 24 bp, Homo sapiens
aacaggatttcgttgtttttgagc

SEQ ID NO: 42974 - DNA, 24 bp, Homo sapiens
caacaggatttcgttgtttttgag

SEQ ID NO: 42975 - DNA, 24 bp, Homo sapiens
tcaacaggatttcgttgtttttga

SEQ ID NO: 42976 - DNA, 23 bp, Homo sapiens
atctcctgaccttgtgatccgcc

SEQ ID NO: 42977 - DNA, 25 bp, Homo sapiens
accatttatccctccagtgacttgc

SEQ ID NO: 42978 - DNA, 25 bp, Homo sapiens
agtggtgtaacctgagccatgtatt

SEQ ID NO: 42979 - DNA, 24 bp, Homo sapiens
ttctcttttagtttattagaagaa

SEQ ID NO: 42980 - DNA, 24 bp, Homo sapiens
cttctcttttagtttattagaaga

SEQ ID NO: 42981 - DNA, 24 bp, Homo sapiens
tcttctcttttagtttattagaag

SEQ ID NO: 42982 - DNA, 24 bp, Homo sapiens
ttttcttcacaaattgaaatagaa

SEQ ID NO: 42983 - DNA, 24 bp, Homo sapiens
cttttcttcacaaattgaaataga

SEQ ID NO: 42984 - DNA, 24 bp, Homo sapiens
gcttttcttcacaaattgaaatag

SEQ ID NO: 42985 - DNA, 24 bp, Homo sapiens
ctcatcgacagaggaagaatacaa

SEQ ID NO: 42986 - DNA, 24 bp, Homo sapiens
cctcatcgacagaggaagaataca

SEQ ID NO: 42987 - DNA, 24 bp, Homo sapiens
tcctcatcgacagaggaagaatac

SEQ ID NO: 42988 - DNA, 23 bp, Homo sapiens
gccaggagaccgaggtgctgtac

SEQ ID NO: 42989 - DNA, 24 bp, Homo sapiens
agaaccactggatgcctgctacct

SEQ ID NO: 42990 - DNA, 25 bp, Homo sapiens
atggcttacctgtcggagaatgtca

SEQ ID NO: 42991 - DNA, 24 bp, Homo sapiens
gttccgcctacgagtacatccacg

SEQ ID NO: 42992 - DNA, 23 bp, Homo sapiens
gccttcctcagccgccacagcct

SEQ ID NO: 42993 - DNA, 23 bp, Homo sapiens
gtgcctggtgctcatctgcgaag

SEQ ID NO: 42994 - DNA, 23 bp, Homo sapiens
ctcacacgctgcccttcgcccgc

SEQ ID NO: 42995 - DNA, 23 bp, Homo sapiens
gccaggagaccgaggtgctgtac

SEQ ID NO: 42996 - DNA, 23 bp, Homo sapiens
cgcctcaccatcagctacctgcg

SEQ ID NO: 42997 - DNA, 25 bp, Homo sapiens
atgatgacttccagctcaacgccag

SEQ ID NO: 42998 - DNA, 23 bp, Homo sapiens
cagaggacgaggacgagggagtg

SEQ ID NO: 42999 - DNA, 23 bp, Homo sapiens
gcctgtcacctccagcccttgag

SEQ ID NO: 43000 - DNA, 23 bp, Homo sapiens
gcggtcagcaagagcatccacac

SEQ ID NO: 43001 - DNA, 24 bp, Homo sapiens
gttccgcctacgagtacatccacg

SEQ ID NO: 43002 - DNA, 23 bp, Homo sapiens
gccttcctcagccgccacagcct

SEQ ID NO: 43003 - DNA, 24 bp, Homo sapiens
ctgtctttcagtgtccgccctgcc

SEQ ID NO: 43004 - DNA, 24 bp, Homo sapiens
cctgtctttcagtgtccgccctgc

SEQ ID NO: 43005 - DNA, 24 bp, Homo sapiens
tcctgtctttcagtgtccgccctg

SEQ ID NO: 43006 - DNA, 23 bp, Homo sapiens
cgcctgcttcaccttctgcctca

SEQ ID NO: 43007 - DNA, 25 bp, Homo sapiens
caacccagagaagagcagcaccaaa

SEQ ID NO: 43008 - DNA, 23 bp, Homo sapiens
gatgccgaagtcctggaggtgtt

SEQ ID NO: 43009 - DNA, 23 bp, Homo sapiens
ctcgtgaaggagtatgctgcgtt

SEQ ID NO: 43010 - DNA, 24 bp, Homo sapiens
cctgctttcctttggtggtcttca

SEQ ID NO: 43011 - DNA, 23 bp, Homo sapiens
aaggaagacaaggcaaggcaggc

SEQ ID NO: 43012 - DNA, 23 bp, Homo sapiens
ccaacagccagcactcttctcct

SEQ ID NO: 43013 - DNA, 25 bp, Homo sapiens
actcagtgccaactccatcaaggtg

SEQ ID NO: 43014 - DNA, 23 bp, Homo sapiens
acagcgatgaggagtcaagcaga

SEQ ID NO: 43015 - DNA, 23 bp, Homo sapiens
cacagaaggcagcaccaggcatc

SEQ ID NO: 43016 - DNA, 24 bp, Homo sapiens
agataaaggtagggtaggcaaggc

SEQ ID NO: 43017 - DNA, 23 bp, Homo sapiens
cctcagccctgcttcctgtggac

SEQ ID NO: 43018 - DNA, 23 bp, Homo sapiens
cagcctcagccctgcttcctgtg

SEQ ID NO: 43019 - DNA, 23 bp, Homo sapiens
tcacagaaggcagcaccaggcat

SEQ ID NO: 43020 - DNA, 23 bp, Homo sapiens
gcagtgatgctcttgccctcagg

SEQ ID NO: 43021 - DNA, 24 bp, Homo sapiens
acagggaaaagtgcaagcaatttg

SEQ ID NO: 43022 - DNA, 24 bp, Homo sapiens
gacagggaaaagtgcaagcaattt

SEQ ID NO: 43023 - DNA, 24 bp, Homo sapiens
ggacagggaaaagtgcaagcaatt

SEQ ID NO: 43024 - DNA, 24 bp, Homo sapiens
aagcattgcagtgcagagccctag

SEQ ID NO: 43025 - DNA, 23 bp, Homo sapiens
ccctgagttctggtgccaaagcc

SEQ ID NO: 43026 - DNA, 23 bp, Homo sapiens
actgctgcctggaccacctcatc

SEQ ID NO: 43027 - DNA, 25 bp, Homo sapiens
gcaaccaagtgcttgacgactactt

SEQ ID NO: 43028 - DNA, 25 bp, Homo sapiens
cgactacttccagaaccagactgac

SEQ ID NO: 43029 - DNA, 23 bp, Homo sapiens
ccagagccagagcaggagccagg

SEQ ID NO: 43030 - DNA, 24 bp, Homo sapiens
aaagaactcaggtatttgaatttc

SEQ ID NO: 43031 - DNA, 24 bp, Homo sapiens
taaagaactcaggtatttgaattt

SEQ ID NO: 43032 - DNA, 24 bp, Homo sapiens
ttaaagaactcaggtatttgaatt

SEQ ID NO: 43033 - DNA, 24 bp, Homo sapiens
ttgctcaagaggtatgtattctaa

SEQ ID NO: 43034 - DNA, 24 bp, Homo sapiens
cttgctcaagaggtatgtattcta

SEQ ID NO: 43035 - DNA, 24 bp, Homo sapiens
tcttgctcaagaggtatgtattct

SEQ ID NO: 43036 - DNA, 24 bp, Homo sapiens
gtggaataaagggaggagatgaaa

SEQ ID NO: 43037 - DNA, 24 bp, Homo sapiens
agtggaataaagggaggagatgaa

SEQ ID NO: 43038 - DNA, 24 bp, Homo sapiens
aagtggaataaagggaggagatga

SEQ ID NO: 43039 - DNA, 25 bp, Homo sapiens
cagttcttcgtggtagaggagtaca

SEQ ID NO: 43040 - DNA, 23 bp, Homo sapiens
cgctactgctgctgctgctgctg

SEQ ID NO: 43041 - DNA, 23 bp, Homo sapiens
ggtgcctctcgtccatgctcctg

SEQ ID NO: 43042 - DNA, 25 bp, Homo sapiens
ctcattgaaggttatggtgggcggg

SEQ ID NO: 43043 - DNA, 23 bp, Homo sapiens
gtcaatcacacgcccacacacct

SEQ ID NO: 43044 - DNA, 25 bp, Homo sapiens
ggatgacaacagcgacgaagaggag

SEQ ID NO: 43045 - DNA, 24 bp, Homo sapiens
gaggtggtggtgcgtgctacttac

SEQ ID NO: 43046 - DNA, 25 bp, Homo sapiens
ggatattgtatgtctgggtgtgagc

SEQ ID NO: 43047 - DNA, 23 bp, Homo sapiens
gatggagctgacagtctggaggc

SEQ ID NO: 43048 - DNA, 23 bp, Homo sapiens
gtctctggctgtcagggtttggc

SEQ ID NO: 43049 - DNA, 24 bp, Homo sapiens
gtgaccacctcttcctgtgctcag

SEQ ID NO: 43050 - DNA, 23 bp, Homo sapiens
gcggcggctacaggagatcagtg

SEQ ID NO: 43051 - DNA, 23 bp, Homo sapiens
ggctgttgcggtgtcgtgaggag

SEQ ID NO: 43052 - DNA, 23 bp, Homo sapiens
agccgcttccaggagaggttctt

SEQ ID NO: 43053 - DNA, 23 bp, Homo sapiens
gcctgctgctgctcaaggagaag

SEQ ID NO: 43054 - DNA, 23 bp, Homo sapiens
cttcgcctcctgggtcacctgtg

SEQ ID NO: 43055 - DNA, 23 bp, Homo sapiens
gacagtcagcgtggagtatcagg

SEQ ID NO: 43056 - DNA, 25 bp, Homo sapiens
ccttaatgagaagagtgtggatggt

SEQ ID NO: 43057 - DNA, 24 bp, Homo sapiens
ttgtaatggagttttgatgcttga

SEQ ID NO: 43058 - DNA, 24 bp, Homo sapiens
tttgtaatggagttttgatgcttg

SEQ ID NO: 43059 - DNA, 24 bp, Homo sapiens
ctttgtaatggagttttgatgctt

SEQ ID NO: 43060 - DNA, 24 bp, Homo sapiens
acattgccaagaaattctgacaaa

SEQ ID NO: 43061 - DNA, 24 bp, Homo sapiens
tacattgccaagaaattctgacaa

SEQ ID NO: 43062 - DNA, 24 bp, Homo sapiens
ttacattgccaagaaattctgaca

SEQ ID NO: 43063 - DNA, 24 bp, Homo sapiens
aacatgcacagatatccataaaag

SEQ ID NO: 43064 - DNA, 24 bp, Homo sapiens
taacatgcacagatatccataaaa

SEQ ID NO: 43065 - DNA, 24 bp, Homo sapiens
ttaacatgcacagatatccataaa

SEQ ID NO: 43066 - DNA, 24 bp, Homo sapiens
agaaacgaattatatctattgaaa

SEQ ID NO: 43067 - DNA, 24 bp, Homo sapiens
aagaaacgaattatatctattgaa

SEQ ID NO: 43068 - DNA, 24 bp, Homo sapiens
gaagaaacgaattatatctattga

SEQ ID NO: 43069 - DNA, 24 bp, Homo sapiens
ccagcatcgagcgactattctcct

SEQ ID NO: 43070 - DNA, 24 bp, Homo sapiens
agccaagcccaaggagcccaccat

SEQ ID NO: 43071 - DNA, 24 bp, Homo sapiens
tccctgagcagccccgacgccgag

SEQ ID NO: 43072 - DNA, 23 bp, Homo sapiens
acggagtcttgctctgtcgccag

SEQ ID NO: 43073 - DNA, 23 bp, Homo sapiens
gcagtggcgtaatctcggctcac

SEQ ID NO: 43074 - DNA, 25 bp, Homo sapiens
cctcacatgatattactgccttggc

SEQ ID NO: 43075 - DNA, 25 bp, Homo sapiens
tggtctccgcaagtccttcctgtat

SEQ ID NO: 43076 - DNA, 25 bp, Homo sapiens
ggtgacagaagaggaagccaatcgc

SEQ ID NO: 43077 - DNA, 23 bp, Homo sapiens
aaggaacggaagcgacaggagcg

SEQ ID NO: 43078 - DNA, 25 bp, Homo sapiens
aggctggttgtagtttcggtctcac

SEQ ID NO: 43079 - DNA, 23 bp, Homo sapiens
ctagatgctaacaagatggcggc

SEQ ID NO: 43080 - DNA, 23 bp, Homo sapiens
agcagagccacgaggagctgaag

SEQ ID NO: 43081 - DNA, 24 bp, Homo sapiens
ccttactcctctggctgtattccg

SEQ ID NO: 43082 - DNA, 23 bp, Homo sapiens
ggtgacagagcgagactccatct

SEQ ID NO: 43083 - DNA, 23 bp, Homo sapiens
gctggtaggcgtggctgtcggtg

SEQ ID NO: 43084 - DNA, 24 bp, Homo sapiens
taaaaaaataggctggatctgcta

SEQ ID NO: 43085 - DNA, 24 bp, Homo sapiens
ttaaaaaaataggctggatctgct

SEQ ID NO: 43086 - DNA, 24 bp, Homo sapiens
tttaaaaaaataggctggatctgc

SEQ ID NO: 43087 - DNA, 25 bp, Homo sapiens
ttgcctgctttgaacactttgccac

SEQ ID NO: 43088 - DNA, 24 bp, Homo sapiens
gcttacccgcagagtggaggacta

SEQ ID NO: 43089 - DNA, 25 bp, Homo sapiens
tccaggatcagtagaatcacagagg

SEQ ID NO: 43090 - DNA, 24 bp, Homo sapiens
tctacctgaaggtacataaataga

SEQ ID NO: 43091 - DNA, 24 bp, Homo sapiens
atctacctgaaggtacataaatag

SEQ ID NO: 43092 - DNA, 24 bp, Homo sapiens
aatctacctgaaggtacataaata

SEQ ID NO: 43093 - DNA, 24 bp, Homo sapiens
ccacgatggtgtcagactcctggc

SEQ ID NO: 43094 - DNA, 24 bp, Homo sapiens
tgcctcaccttcccaaagtgcttg

SEQ ID NO: 43095 - DNA, 24 bp, Homo sapiens
tgacccgctgtttgtttggaatgc

SEQ ID NO: 43096 - DNA, 25 bp, Homo sapiens
gcttagcatatagtcggcactcagg

SEQ ID NO: 43097 - DNA, 24 bp, Homo sapiens
aggacctgtggagatagggaaggg

SEQ ID NO: 43098 - DNA, 25 bp, Homo sapiens
atgtgctgggattacagttgtcacg

SEQ ID NO: 43099 - DNA, 24 bp, Homo sapiens
caagaccttaggtaagaatttttg

SEQ ID NO: 43100 - DNA, 24 bp, Homo sapiens
tcaagaccttaggtaagaattttt

SEQ ID NO: 43101 - DNA, 24 bp, Homo sapiens
ttcaagaccttaggtaagaatttt

SEQ ID NO: 43102 - DNA, 24 bp, Homo sapiens
tttggaaaggttgttctgttgaag

SEQ ID NO: 43103 - DNA, 24 bp, Homo sapiens
ttttggaaaggttgttctgttgaa

SEQ ID NO: 43104 - DNA, 24 bp, Homo sapiens
gttttggaaaggttgttctgttga

SEQ ID NO: 43105 - DNA, 24 bp, Homo sapiens
acttttgacaggtaagaaaaaaat

SEQ ID NO: 43106 - DNA, 24 bp, Homo sapiens
aacttttgacaggtaagaaaaaaa

SEQ ID NO: 43107 - DNA, 24 bp, Homo sapiens
taacttttgacaggtaagaaaaaa

SEQ ID NO: 43108 - DNA, 23 bp, Homo sapiens
gagattccagtcgctgctcctgc

SEQ ID NO: 43109 - DNA, 23 bp, Homo sapiens
ggctgctggtgctgtgcgcgagg

SEQ ID NO: 43110 - DNA, 24 bp, Homo sapiens
acaagtccaacctcaagatagcgg

SEQ ID NO: 43111 - DNA, 24 bp, Homo sapiens
ccgtggcttactacaagaaggctc

SEQ ID NO: 43112 - DNA, 24 bp, Homo sapiens
caacagagccgcagcctacagcaa

SEQ ID NO: 43113 - DNA, 24 bp, Homo sapiens
ggacagagcgagactccatctcaa

SEQ ID NO: 43114 - DNA, 25 bp, Homo sapiens
ttgactgagttagaatttagagagt

SEQ ID NO: 43115 - DNA, 24 bp, Homo sapiens
gcgggcgggacggagctgcggcgg

SEQ ID NO: 43116 - DNA, 24 bp, Homo sapiens
agccgccgcctcgacccagggccc

SEQ ID NO: 43117 - DNA, 24 bp, Homo sapiens
cgcgggcgggagcgcctggcggcc

SEQ ID NO: 43118 - DNA, 24 bp, Homo sapiens
aaaggaagaaggagcttttaagtg

SEQ ID NO: 43119 - DNA, 24 bp, Homo sapiens
taaaggaagaaggagcttttaagt

SEQ ID NO: 43120 - DNA, 24 bp, Homo sapiens
ctaaaggaagaaggagcttttaag

SEQ ID NO: 43121 - DNA, 24 bp, Homo sapiens
atctcctgacctcgtgatccgcct

SEQ ID NO: 43122 - DNA, 24 bp, Homo sapiens
tgaggctggttcttgggtttgact

SEQ ID NO: 43123 - DNA, 24 bp, Homo sapiens
gcccagcctcttctctcactatcc

SEQ ID NO: 43124 - DNA, 23 bp, Homo sapiens
cgccacagcagcagcagcagcag

SEQ ID NO: 43125 - DNA, 23 bp, Homo sapiens
gcagcaccagcagtttctccagc

SEQ ID NO: 43126 - DNA, 23 bp, Homo sapiens
atggaccaggagcggctgaagaa

SEQ ID NO: 43127 - DNA, 23 bp, Homo sapiens
cgccacagcagcagcagcagcag

SEQ ID NO: 43128 - DNA, 23 bp, Homo sapiens
ggcgaagcgggaggaagaggaac

SEQ ID NO: 43129 - DNA, 23 bp, Homo sapiens
agcagcagcaggaggagcagaag

SEQ ID NO: 43130 - DNA, 23 bp, Homo sapiens
cgccgccacagcagcagcagcag

SEQ ID NO: 43131 - DNA, 23 bp, Homo sapiens
ctccgagaaaaggcagctctggg

SEQ ID NO: 43132 - DNA, 23 bp, Homo sapiens
acggcattcctgcagcagctcca

SEQ ID NO: 43133 - DNA, 23 bp, Homo sapiens
ggcgaagcgggaggaagaggaac

SEQ ID NO: 43134 - DNA, 23 bp, Homo sapiens
agcagcagcaggaggagcagaag

SEQ ID NO: 43135 - DNA, 23 bp, Homo sapiens
ggctgtccatgaagacgctcctg

SEQ ID NO: 43136 - DNA, 23 bp, Homo sapiens
gtacactcacctctcagccgtcg

SEQ ID NO: 43137 - DNA, 23 bp, Homo sapiens
aaaggacggacgaaggacactgc

SEQ ID NO: 43138 - DNA, 23 bp, Homo sapiens
cctcgctcttgggttctgtggtc

SEQ ID NO: 43139 - DNA, 24 bp, Homo sapiens
aattgatccaggtcaaacaggatt

SEQ ID NO: 43140 - DNA, 24 bp, Homo sapiens
caattgatccaggtcaaacaggat

SEQ ID NO: 43141 - DNA, 24 bp, Homo sapiens
acaattgatccaggtcaaacagga

SEQ ID NO: 43142 - DNA, 24 bp, Homo sapiens
ttctcttataggtttagtttcagg

SEQ ID NO: 43143 - DNA, 24 bp, Homo sapiens
attctcttataggtttagtttcag

SEQ ID NO: 43144 - DNA, 24 bp, Homo sapiens
tattctcttataggtttagtttca

SEQ ID NO: 43145 - DNA, 25 bp, Homo sapiens
tgatgaggaactctatgttgctgga

SEQ ID NO: 43146 - DNA, 24 bp, Homo sapiens
cagcaggcattgtggtgtgacttc

SEQ ID NO: 43147 - DNA, 25 bp, Homo sapiens
ttcacccagagaacctttacctact

SEQ ID NO: 43148 - DNA, 24 bp, Homo sapiens
ggagagggcagtctgggatgtggc

SEQ ID NO: 43149 - DNA, 24 bp, Homo sapiens
tggagagggcagtctgggatgtgg

SEQ ID NO: 43150 - DNA, 24 bp, Homo sapiens
gtggagagggcagtctgggatgtg

SEQ ID NO: 43151 - DNA, 25 bp, Homo sapiens
acaagtagccacctgagttcctgag

SEQ ID NO: 43152 - DNA, 25 bp, Homo sapiens
ccttccatctgattccagcacaacc

SEQ ID NO: 43153 - DNA, 23 bp, Homo sapiens
gaggtggagtctcgctctgttgc

SEQ ID NO: 43154 - DNA, 24 bp, Homo sapiens
ctacaggaaaggagtgaaaagtgt

SEQ ID NO: 43155 - DNA, 24 bp, Homo sapiens
tctacaggaaaggagtgaaaagtg

SEQ ID NO: 43156 - DNA, 24 bp, Homo sapiens
ttctacaggaaaggagtgaaaagt

SEQ ID NO: 43157 - DNA, 25 bp, Homo sapiens
ctgattgcctcggagaatttcgcca

SEQ ID NO: 43158 - DNA, 25 bp, Homo sapiens
acatcattaagaaggagagtaaccg

SEQ ID NO: 43159 - DNA, 25 bp, Homo sapiens
tcctcacatgacaagatgctggcac

SEQ ID NO: 43160 - DNA, 24 bp, Homo sapiens
gccctactcaggtgaacccagata

SEQ ID NO: 43161 - DNA, 24 bp, Homo sapiens
agccctactcaggtgaacccagat

SEQ ID NO: 43162 - DNA, 24 bp, Homo sapiens
cagccctactcaggtgaacccaga

SEQ ID NO: 43163 - DNA, 24 bp, Homo sapiens
gccaagtcaagccctatctcctga

SEQ ID NO: 43164 - DNA, 24 bp, Homo sapiens
ggccaagtcaagccctatctcctg

SEQ ID NO: 43165 - DNA, 24 bp, Homo sapiens
cggccaagtcaagccctatctcct

SEQ ID NO: 43166 - DNA, 23 bp, Homo sapiens
tgcccacactaccacaatagccg

SEQ ID NO: 43167 - DNA, 23 bp, Homo sapiens
ggcagctacaagacggagcagtg

SEQ ID NO: 43168 - DNA, 23 bp, Homo sapiens
gccgccacgcctgtgccgccagg

SEQ ID NO: 43169 - DNA, 24 bp, Homo sapiens
catttcagcaggatagtcattgca

SEQ ID NO: 43170 - DNA, 24 bp, Homo sapiens
ccatttcagcaggatagtcattgc

SEQ ID NO: 43171 - DNA, 24 bp, Homo sapiens
gccatttcagcaggatagtcattg

SEQ ID NO: 43172 - DNA, 24 bp, Homo sapiens
cacagcaacaggcagcattacaga

SEQ ID NO: 43173 - DNA, 24 bp, Homo sapiens
gcacagcaacaggcagcattacag

SEQ ID NO: 43174 - DNA, 24 bp, Homo sapiens
tgcacagcaacaggcagcattaca

SEQ ID NO: 43175 - DNA, 24 bp, Homo sapiens
tggctagaattgtaagtataatga

SEQ ID NO: 43176 - DNA, 24 bp, Homo sapiens
atggctagaattgtaagtataatg

SEQ ID NO: 43177 - DNA, 24 bp, Homo sapiens
catggctagaattgtaagtataat

SEQ ID NO: 43178 - DNA, 23 bp, Homo sapiens
gtgctggctggcttcctgacagg

SEQ ID NO: 43179 - DNA, 23 bp, Homo sapiens
ctggtcaaaccctcgctctgcct

SEQ ID NO: 43180 - DNA, 23 bp, Homo sapiens
tggccgagtaccgaaaccactgg

SEQ ID NO: 43181 - DNA, 23 bp, Homo sapiens
gattacagatcccagagcctcga

SEQ ID NO: 43182 - DNA, 25 bp, Homo sapiens
catgtccccttctttcctctgcacc

SEQ ID NO: 43183 - DNA, 23 bp, Homo sapiens
gcagccagccccccaccccccag

SEQ ID NO: 43184 - DNA, 25 bp, Homo sapiens
ccagcaatgagaactgtcgcaagac

SEQ ID NO: 43185 - DNA, 23 bp, Homo sapiens
gttacaccagcacccagaccagc

SEQ ID NO: 43186 - DNA, 25 bp, Homo sapiens
gcactaccagcaacagcagcattac

SEQ ID NO: 43187 - DNA, 24 bp, Homo sapiens
ctccacatctacgccaactaccgc

SEQ ID NO: 43188 - DNA, 23 bp, Homo sapiens
cctcctgatgctccctctggtgt

SEQ ID NO: 43189 - DNA, 23 bp, Homo sapiens
ccaaggacagcagccaggagacg

SEQ ID NO: 43190 - DNA, 25 bp, Homo sapiens
aaacgcagtgaatttcggaagcagc

SEQ ID NO: 43191 - DNA, 24 bp, Homo sapiens
gccaaccctttctacgaccgctac

SEQ ID NO: 43192 - DNA, 23 bp, Homo sapiens
catggctgctgtggtggtggcgg

SEQ ID NO: 43193 - DNA, 23 bp, Homo sapiens
atggctgctgtggtggtggcggc

SEQ ID NO: 43194 - DNA, 23 bp, Homo sapiens
gcgcgggaccggcggtcctgcag

SEQ ID NO: 43195 - DNA, 24 bp, Homo sapiens
cacaggtggagtgtgccggccctt

SEQ ID NO: 43196 - DNA, 24 bp, Homo sapiens
acacaggtggagtgtgccggccct

SEQ ID NO: 43197 - DNA, 24 bp, Homo sapiens
gacacaggtggagtgtgccggccc

SEQ ID NO: 43198 - DNA, 24 bp, Homo sapiens
ttcactgcaggggcgggaaaggac

SEQ ID NO: 43199 - DNA, 24 bp, Homo sapiens
attcactgcaggggcgggaaagga

SEQ ID NO: 43200 - DNA, 24 bp, Homo sapiens
cattcactgcaggggcgggaaagg

SEQ ID NO: 43201 - DNA, 24 bp, Homo sapiens
ttctaaaacagggagcagatactg

SEQ ID NO: 43202 - DNA, 24 bp, Homo sapiens
gttctaaaacagggagcagatact

SEQ ID NO: 43203 - DNA, 24 bp, Homo sapiens
tgttctaaaacagggagcagatac

SEQ ID NO: 43204 - DNA, 24 bp, Homo sapiens
gaatatcatatgtaagtagtttta

SEQ ID NO: 43205 - DNA, 24 bp, Homo sapiens
ggaatatcatatgtaagtagtttt

SEQ ID NO: 43206 - DNA, 24 bp, Homo sapiens
tggaatatcatatgtaagtagttt

SEQ ID NO: 43207 - DNA, 24 bp, Homo sapiens
acaacgggttgatatgtatcttcc

SEQ ID NO: 43208 - DNA, 24 bp, Homo sapiens
tatcatccccattcaagaaccaga

SEQ ID NO: 43209 - DNA, 24 bp, Homo sapiens
caaaataggattacatcttagagg

SEQ ID NO: 43210 - DNA, 24 bp, Homo sapiens
ttttgccagaaatttgccaacatt

SEQ ID NO: 43211 - DNA, 24 bp, Homo sapiens
cttttgccagaaatttgccaacat

SEQ ID NO: 43212 - DNA, 24 bp, Homo sapiens
gcttttgccagaaatttgccaaca

SEQ ID NO: 43213 - DNA, 24 bp, Homo sapiens
cggtggctcatgcctataatccca

SEQ ID NO: 43214 - DNA, 23 bp, Homo sapiens
ccatagaaagaagaaaactgggc

SEQ ID NO: 43215 - DNA, 24 bp, Homo sapiens
cattgaaaagacagattataatat

SEQ ID NO: 43216 - DNA, 24 bp, Homo sapiens
tcattgaaaagacagattataata

SEQ ID NO: 43217 - DNA, 24 bp, Homo sapiens
ctcattgaaaagacagattataat

SEQ ID NO: 43218 - DNA, 24 bp, Homo sapiens
tgcatcacaagaggattcagaaat

SEQ ID NO: 43219 - DNA, 24 bp, Homo sapiens
ttgcatcacaagaggattcagaaa

SEQ ID NO: 43220 - DNA, 24 bp, Homo sapiens
tttgcatcacaagaggattcagaa

SEQ ID NO: 43221 - DNA, 24 bp, Homo sapiens
gaagtgagcaggctgaggccacca

SEQ ID NO: 43222 - DNA, 24 bp, Homo sapiens
ggaagtgagcaggctgaggccacc

SEQ ID NO: 43223 - DNA, 24 bp, Homo sapiens
cggaagtgagcaggctgaggccac

SEQ ID NO: 43224 - DNA, 23 bp, Homo sapiens
agcaggctgggaaggatgtcacc

SEQ ID NO: 43225 - DNA, 24 bp, Homo sapiens
ttgcagccgatgtttacgttggga

SEQ ID NO: 43226 - DNA, 25 bp, Homo sapiens
tgtgagtgacctgaagagagccctg

SEQ ID NO: 43227 - DNA, 25 bp, Homo sapiens
agacactgccacttctactcagagg

SEQ ID NO: 43228 - DNA, 23 bp, Homo sapiens
gtgcctggaagttctgacagccg

SEQ ID NO: 43229 - DNA, 25 bp, Homo sapiens
ctcaagatcactcagcgtctccgtt

SEQ ID NO: 43230 - DNA, 25 bp, Homo sapiens
tttcttgccaaatgagtgtctcttt

SEQ ID NO: 43231 - DNA, 24 bp, Homo sapiens
atgagagttaggaagttcccgact

SEQ ID NO: 43232 - DNA, 25 bp, Homo sapiens
tagctgagtcttacgtgaaaatatg

SEQ ID NO: 43233 - DNA, 24 bp, Homo sapiens
ttaacttgctggcaaagctgcaga

SEQ ID NO: 43234 - DNA, 24 bp, Homo sapiens
attaacttgctggcaaagctgcag

SEQ ID NO: 43235 - DNA, 24 bp, Homo sapiens
gattaacttgctggcaaagctgca

SEQ ID NO: 43236 - DNA, 24 bp, Homo sapiens
gacaccaggagaagattcggcagc

SEQ ID NO: 43237 - DNA, 25 bp, Homo sapiens
gtccacttcttccactgcgatgagg

SEQ ID NO: 43238 - DNA, 23 bp, Homo sapiens
ccgtctgtgctgctgctcgtgtg

SEQ ID NO: 43239 - DNA, 23 bp, Homo sapiens
gctctgcccggcttcctcagtct

SEQ ID NO: 43240 - DNA, 23 bp, Homo sapiens
gagtggcgggccgactgtgtagt

SEQ ID NO: 43241 - DNA, 23 bp, Homo sapiens
cgggagcgtccgggagcagctcc

SEQ ID NO: 43242 - DNA, 24 bp, Homo sapiens
ctgtctttcagcctgcaagataaa

SEQ ID NO: 43243 - DNA, 24 bp, Homo sapiens
actgtctttcagcctgcaagataa

SEQ ID NO: 43244 - DNA, 24 bp, Homo sapiens
cactgtctttcagcctgcaagata

SEQ ID NO: 43245 - DNA, 24 bp, Homo sapiens
tattcaccatggctgatgagccct

SEQ ID NO: 43246 - DNA, 24 bp, Homo sapiens
ttattcaccatggctgatgagccc

SEQ ID NO: 43247 - DNA, 24 bp, Homo sapiens
attattcaccatggctgatgagcc

SEQ ID NO: 43248 - DNA, 25 bp, Homo sapiens
tgagatttgaagaggagcaacagtc

SEQ ID NO: 43249 - DNA, 25 bp, Homo sapiens
taagaccaccattgctgatattgaa

SEQ ID NO: 43250 - DNA, 25 bp, Homo sapiens
ttgctcgccatctcttcatcatcca

SEQ ID NO: 43251 - DNA, 24 bp, Homo sapiens
gcttttcaaaaatgaaatgaagag

SEQ ID NO: 43252 - DNA, 24 bp, Homo sapiens
ggcttttcaaaaatgaaatgaaga

SEQ ID NO: 43253 - DNA, 24 bp, Homo sapiens
gggcttttcaaaaatgaaatgaag

SEQ ID NO: 43254 - DNA, 24 bp, Homo sapiens
cagcacctcccagccccgcagaat

SEQ ID NO: 43255 - DNA, 24 bp, Homo sapiens
gagacaatggggatgtgggcgcgg

SEQ ID NO: 43256 - DNA, 24 bp, Homo sapiens
gatcgcgccccctccgcgcgcgcc

SEQ ID NO: 43257 - DNA, 24 bp, Homo sapiens
gaatacgaaaagtaagcaaatgaa

SEQ ID NO: 43258 - DNA, 24 bp, Homo sapiens
ggaatacgaaaagtaagcaaatga

SEQ ID NO: 43259 - DNA, 24 bp, Homo sapiens
aggaatacgaaaagtaagcaaatg

SEQ ID NO: 43260 - DNA, 24 bp, Homo sapiens
aaaagaaatagaaacccgatggac

SEQ ID NO: 43261 - DNA, 24 bp, Homo sapiens
aaaaagaaatagaaacccgatgga

SEQ ID NO: 43262 - DNA, 24 bp, Homo sapiens
caaaaagaaatagaaacccgatgg

SEQ ID NO: 43263 - DNA, 25 bp, Homo sapiens
atgctaagacacctttcctcctggc

SEQ ID NO: 43264 - DNA, 25 bp, Homo sapiens
gattcaggacattggttcaggaaga

SEQ ID NO: 43265 - DNA, 23 bp, Homo sapiens
aagatgaacagcagcagccagat

SEQ ID NO: 43266 - DNA, 25 bp, Homo sapiens
tgaccaagaagatgaccacagaaga

SEQ ID NO: 43267 - DNA, 25 bp, Homo sapiens
tgacttcagcaaggagcctaatgga

SEQ ID NO: 43268 - DNA, 23 bp, Homo sapiens
gccgcagcctccaactccttcaa

SEQ ID NO: 43269 - DNA, 23 bp, Homo sapiens
gccgcagcctccaactccttcaa

SEQ ID NO: 43270 - DNA, 25 bp, Homo sapiens
ttaagaaggtactggaagacactgg

SEQ ID NO: 43271 - DNA, 25 bp, Homo sapiens
tgacttcagcaaggagcctaatgga

SEQ ID NO: 43272 - DNA, 25 bp, Homo sapiens
tggagtgaacttggattctctcaac

SEQ ID NO: 43273 - DNA, 24 bp, Homo sapiens
ggcaggaagcagagaacagcaagt

SEQ ID NO: 43274 - DNA, 25 bp, Homo sapiens
caatgtggagatatgttggtgagaa

SEQ ID NO: 43275 - DNA, 23 bp, Homo sapiens
cagaaggcggcggctggctctcc

SEQ ID NO: 43276 - DNA, 23 bp, Homo sapiens
ccaccgagtcgggcgatgggccg

SEQ ID NO: 43277 - DNA, 23 bp, Homo sapiens
gacagactccgtggcccgctcga

SEQ ID NO: 43278 - DNA, 24 bp, Homo sapiens
acctaaccaagctaagaaaccttt

SEQ ID NO: 43279 - DNA, 24 bp, Homo sapiens
cacctaaccaagctaagaaacctt

SEQ ID NO: 43280 - DNA, 24 bp, Homo sapiens
tcacctaaccaagctaagaaacct

SEQ ID NO: 43281 - DNA, 24 bp, Homo sapiens
tttcctgccagagcgactctacct

SEQ ID NO: 43282 - DNA, 24 bp, Homo sapiens
ctttcctgccagagcgactctacc

SEQ ID NO: 43283 - DNA, 24 bp, Homo sapiens
tctttcctgccagagcgactctac

SEQ ID NO: 43284 - DNA, 24 bp, Homo sapiens
ttaaatttcaggttattatcaacc

SEQ ID NO: 43285 - DNA, 24 bp, Homo sapiens
tttaaatttcaggttattatcaac

SEQ ID NO: 43286 - DNA, 24 bp, Homo sapiens
ttttaaatttcaggttattatcaa

SEQ ID NO: 43287 - DNA, 24 bp, Homo sapiens
ttattatttagtacagggaagacc

SEQ ID NO: 43288 - DNA, 24 bp, Homo sapiens
tttattatttagtacagggaagac

SEQ ID NO: 43289 - DNA, 24 bp, Homo sapiens
ttttattatttagtacagggaaga

SEQ ID NO: 43290 - DNA, 23 bp, Homo sapiens
gcagcagcggccaagaaggtgtg

SEQ ID NO: 43291 - DNA, 23 bp, Homo sapiens
gcggcggctgctggtgctgctgt

SEQ ID NO: 43292 - DNA, 23 bp, Homo sapiens
cgctcgcgctgctgccggtggtc

SEQ ID NO: 43293 - DNA, 25 bp, Homo sapiens
ccaagtgatgctcttatcatagcct

SEQ ID NO: 43294 - DNA, 23 bp, Homo sapiens
gctggtgtgtagtggtgcaatca

SEQ ID NO: 43295 - DNA, 23 bp, Homo sapiens
cagctcactgcagcctcaacatc

SEQ ID NO: 43296 - DNA, 25 bp, Homo sapiens
ggagcaatgaccaggacacatacag

SEQ ID NO: 43297 - DNA, 23 bp, Homo sapiens
gaggcagtggctgaggcagaact

SEQ ID NO: 43298 - DNA, 25 bp, Homo sapiens
caagatggaatcagtggtcctgcca

SEQ ID NO: 43299 - DNA, 24 bp, Homo sapiens
ttatcaacaagataaactatcaac

SEQ ID NO: 43300 - DNA, 24 bp, Homo sapiens
tttatcaacaagataaactatcaa

SEQ ID NO: 43301 - DNA, 24 bp, Homo sapiens
ttttatcaacaagataaactatca

SEQ ID NO: 43302 - DNA, 24 bp, Homo sapiens
ttcttttgcaggagctattgtgac

SEQ ID NO: 43303 - DNA, 24 bp, Homo sapiens
cttcttttgcaggagctattgtga

SEQ ID NO: 43304 - DNA, 24 bp, Homo sapiens
ccttcttttgcaggagctattgtg

SEQ ID NO: 43305 - DNA, 24 bp, Homo sapiens
gatgagtacaagtaagtagtatgt

SEQ ID NO: 43306 - DNA, 24 bp, Homo sapiens
tgatgagtacaagtaagtagtatg

SEQ ID NO: 43307 - DNA, 24 bp, Homo sapiens
atgatgagtacaagtaagtagtat

SEQ ID NO: 43308 - DNA, 24 bp, Homo sapiens
gtgaaaaagaagaaaaagaagaca

SEQ ID NO: 43309 - DNA, 24 bp, Homo sapiens
tgtgaaaaagaagaaaaagaagac

SEQ ID NO: 43310 - DNA, 24 bp, Homo sapiens
gtgtgaaaaagaagaaaaagaaga

SEQ ID NO: 43311 - DNA, 23 bp, Homo sapiens
agacctgctcttctcggtgacac

SEQ ID NO: 43312 - DNA, 23 bp, Homo sapiens
cttcagcctggacgaggatgtgc

SEQ ID NO: 43313 - DNA, 23 bp, Homo sapiens
ttaaggagcggagcggcgtggtc

SEQ ID NO: 43314 - DNA, 24 bp, Homo sapiens
gggatcctcgggtatgtgatttat

SEQ ID NO: 43315 - DNA, 24 bp, Homo sapiens
tgggatcctcgggtatgtgattta

SEQ ID NO: 43316 - DNA, 24 bp, Homo sapiens
ctgggatcctcgggtatgtgattt

SEQ ID NO: 43317 - DNA, 24 bp, Homo sapiens
ttatattttagtttattcgacttg

SEQ ID NO: 43318 - DNA, 24 bp, Homo sapiens
tttatattttagtttattcgactt

SEQ ID NO: 43319 - DNA, 24 bp, Homo sapiens
gtttatattttagtttattcgact

SEQ ID NO: 43320 - DNA, 24 bp, Homo sapiens
gagttcaagtccgacaacaccgtg

SEQ ID NO: 43321 - DNA, 25 bp, Homo sapiens
gcatggcaagttctgtggttctgag

SEQ ID NO: 43322 - DNA, 23 bp, Homo sapiens
gtgaggctgcttgtggcggattc

SEQ ID NO: 43323 - DNA, 24 bp, Homo sapiens
cgactacacctatgacctggcgga

SEQ ID NO: 43324 - DNA, 23 bp, Homo sapiens
cgactcggagcccctcaactaca

SEQ ID NO: 43325 - DNA, 23 bp, Homo sapiens
ggctgctgctgctcccgcgtccc

SEQ ID NO: 43326 - DNA, 24 bp, Homo sapiens
gcattacgctcggaacacattctc

SEQ ID NO: 43327 - DNA, 24 bp, Homo sapiens
gcaagacagcacaggcaacttctc

SEQ ID NO: 43328 - DNA, 24 bp, Homo sapiens
ccaatggctactctgctcacatgc

SEQ ID NO: 43329 - DNA, 24 bp, Homo sapiens
agtttctccaggttgattattcta

SEQ ID NO: 43330 - DNA, 24 bp, Homo sapiens
aagtttctccaggttgattattct

SEQ ID NO: 43331 - DNA, 24 bp, Homo sapiens
gaagtttctccaggttgattattc

SEQ ID NO: 43332 - DNA, 24 bp, Homo sapiens
ctattctttaggtcttcccaaaag

SEQ ID NO: 43333 - DNA, 24 bp, Homo sapiens
tctattctttaggtcttcccaaaa

SEQ ID NO: 43334 - DNA, 24 bp, Homo sapiens
ttctattctttaggtcttcccaaa

SEQ ID NO: 43335 - DNA, 24 bp, Homo sapiens
aacactcttctagcagcattatgg

SEQ ID NO: 43336 - DNA, 24 bp, Homo sapiens
gttggtcgggctggtctggaaatc

SEQ ID NO: 43337 - DNA, 24 bp, Homo sapiens
tgagccattgacttttaaagcagg

SEQ ID NO: 43338 - DNA, 24 bp, Homo sapiens
gagtatgtcaggttttatttcgtc

SEQ ID NO: 43339 - DNA, 24 bp, Homo sapiens
agagtatgtcaggttttatttcgt

SEQ ID NO: 43340 - DNA, 24 bp, Homo sapiens
cagagtatgtcaggttttatttcg

SEQ ID NO: 43341 - DNA, 24 bp, Homo sapiens
atactaaagaggtaagagtcattt

SEQ ID NO: 43342 - DNA, 24 bp, Homo sapiens
aatactaaagaggtaagagtcatt

SEQ ID NO: 43343 - DNA, 24 bp, Homo sapiens
aaatactaaagaggtaagagtcat

SEQ ID NO: 43344 - DNA, 24 bp, Homo sapiens
ttccagaattcgtcaattgtttta

SEQ ID NO: 43345 - DNA, 25 bp, Homo sapiens
tgtaaaaataattaatccccaattc

SEQ ID NO: 43346 - DNA, 24 bp, Homo sapiens
tgtagataaacatattgcatttat

SEQ ID NO: 43347 - DNA, 25 bp, Homo sapiens
caaccactacttcagcgtgaggagc

SEQ ID NO: 43348 - DNA, 23 bp, Homo sapiens
cgcactgttgtcatggaggaacc

SEQ ID NO: 43349 - DNA, 23 bp, Homo sapiens
cgctggtggccgtgctgctgctc

SEQ ID NO: 43350 - DNA, 24 bp, Homo sapiens
atactaaagagtttttgcctgtat

SEQ ID NO: 43351 - DNA, 24 bp, Homo sapiens
aatactaaagagtttttgcctgta

SEQ ID NO: 43352 - DNA, 24 bp, Homo sapiens
aaatactaaagagtttttgcctgt

SEQ ID NO: 43353 - DNA, 24 bp, Homo sapiens
aagaaaaaaaggtaagatatgtat

SEQ ID NO: 43354 - DNA, 24 bp, Homo sapiens
aaagaaaaaaaggtaagatatgta

SEQ ID NO: 43355 - DNA, 24 bp, Homo sapiens
aaaagaaaaaaaggtaagatatgt

SEQ ID NO: 43356 - DNA, 24 bp, Homo sapiens
gccgggcgcaggcgctggtgactg

SEQ ID NO: 43357 - DNA, 24 bp, Homo sapiens
ggccgggcgcaggcgctggtgact

SEQ ID NO: 43358 - DNA, 24 bp, Homo sapiens
cggccgggcgcaggcgctggtgac

SEQ ID NO: 43359 - DNA, 25 bp, Homo sapiens
aggctggagtatagtggtgtgatct

SEQ ID NO: 43360 - DNA, 25 bp, Homo sapiens
tggaattacaggtctggcagaagga

SEQ ID NO: 43361 - DNA, 25 bp, Homo sapiens
attggcagttgtgattcagagacct

SEQ ID NO: 43362 - DNA, 23 bp, Homo sapiens
cacggctggcaagaagaggatgg

SEQ ID NO: 43363 - DNA, 25 bp, Homo sapiens
attggcagttgtgattcagagacct

SEQ ID NO: 43364 - DNA, 25 bp, Homo sapiens
aggctggagtatagtggtgtgatct

SEQ ID NO: 43365 - DNA, 23 bp, Homo sapiens
ctcaagtggaggcagcagactcg

SEQ ID NO: 43366 - DNA, 25 bp, Homo sapiens
tgtatccatcaaccacttcctccag

SEQ ID NO: 43367 - DNA, 25 bp, Homo sapiens
agaattagcaggtgtagagcaagcc

SEQ ID NO: 43368 - DNA, 24 bp, Homo sapiens
ctatggcaaagaacatcagaactt

SEQ ID NO: 43369 - DNA, 24 bp, Homo sapiens
tctatggcaaagaacatcagaact

SEQ ID NO: 43370 - DNA, 24 bp, Homo sapiens
ttctatggcaaagaacatcagaac

SEQ ID NO: 43371 - DNA, 24 bp, Homo sapiens
accagcagcagctcctccggaagc

SEQ ID NO: 43372 - DNA, 24 bp, Homo sapiens
aaccagcagcagctcctccggaag

SEQ ID NO: 43373 - DNA, 24 bp, Homo sapiens
taaccagcagcagctcctccggaa

SEQ ID NO: 43374 - DNA, 24 bp, Homo sapiens
aatcacagcaggaatcttgggatt

SEQ ID NO: 43375 - DNA, 24 bp, Homo sapiens
aaatcacagcaggaatcttgggat

SEQ ID NO: 43376 - DNA, 24 bp, Homo sapiens
gaaatcacagcaggaatcttggga

SEQ ID NO: 43377 - DNA, 24 bp, Homo sapiens
ctcctactcgtgtcccttgagcca

SEQ ID NO: 43378 - DNA, 23 bp, Homo sapiens
ccagtgaccgttaggccgtggcc

SEQ ID NO: 43379 - DNA, 23 bp, Homo sapiens
tcgagcccaccgccacctccagg

SEQ ID NO: 43380 - DNA, 24 bp, Homo sapiens
ttttctgttagatattaaggctaa

SEQ ID NO: 43381 - DNA, 24 bp, Homo sapiens
attttctgttagatattaaggcta

SEQ ID NO: 43382 - DNA, 24 bp, Homo sapiens
tattttctgttagatattaaggct

SEQ ID NO: 43383 - DNA, 25 bp, Homo sapiens
gatggacagaggagcaatagtgagg

SEQ ID NO: 43384 - DNA, 23 bp, Homo sapiens
acagtcagcagcacaacagaggc

SEQ ID NO: 43385 - DNA, 24 bp, Homo sapiens
aagcatggtggagcacttgtctcg

SEQ ID NO: 43386 - DNA, 24 bp, Homo sapiens
taaacgggagcgaggatggagtgg

SEQ ID NO: 43387 - DNA, 24 bp, Homo sapiens
cagcagagagaagagtgggaccga

SEQ ID NO: 43388 - DNA, 23 bp, Homo sapiens
agagcaggagaaggtggaggcag

SEQ ID NO: 43389 - DNA, 24 bp, Homo sapiens
tcttcttccagattaattaaaaga

SEQ ID NO: 43390 - DNA, 24 bp, Homo sapiens
ctcttcttccagattaattaaaag

SEQ ID NO: 43391 - DNA, 24 bp, Homo sapiens
tctcttcttccagattaattaaaa

SEQ ID NO: 43392 - DNA, 24 bp, Homo sapiens
ctttgttccagggctggagcggct

SEQ ID NO: 43393 - DNA, 24 bp, Homo sapiens
cctttgttccagggctggagcggc

SEQ ID NO: 43394 - DNA, 24 bp, Homo sapiens
tcctttgttccagggctggagcgg

SEQ ID NO: 43395 - DNA, 24 bp, Homo sapiens
caggtgaggcgacagtgaaatttc

SEQ ID NO: 43396 - DNA, 24 bp, Homo sapiens
gcaggtgaggcgacagtgaaattt

SEQ ID NO: 43397 - DNA, 24 bp, Homo sapiens
ggcaggtgaggcgacagtgaaatt

SEQ ID NO: 43398 - DNA, 25 bp, Homo sapiens
aagtatgtgattggcatcggagtgg

SEQ ID NO: 43399 - DNA, 23 bp, Homo sapiens
gccaagtttgcactcatcttccc

SEQ ID NO: 43400 - DNA, 23 bp, Homo sapiens
ggctggtgctggtgaacatcgac

SEQ ID NO: 43401 - DNA, 23 bp, Homo sapiens
ggctggtgctggtgaacatcgac

SEQ ID NO: 43402 - DNA, 24 bp, Homo sapiens
gcaaaggctggatagactgggctg

SEQ ID NO: 43403 - DNA, 25 bp, Homo sapiens
gcctaactagcactttacccgacac

SEQ ID NO: 43404 - DNA, 24 bp, Homo sapiens
ggccttctgcatgtagtgatccgg

SEQ ID NO: 43405 - DNA, 23 bp, Homo sapiens
ccaaggggaaccgcccagccatc

SEQ ID NO: 43406 - DNA, 23 bp, Homo sapiens
taccatgatgtgggcctcaacca

SEQ ID NO: 43407 - DNA, 23 bp, Homo sapiens
ggctggtgctggtgaacatcgac

SEQ ID NO: 43408 - DNA, 25 bp, Homo sapiens
caggaggagctggtgaacaacacag

SEQ ID NO: 43409 - DNA, 24 bp, Homo sapiens
gccgcagagacctggacattaacc

SEQ ID NO: 43410 - DNA, 23 bp, Homo sapiens
caatgccaagacgctccgctgcc

SEQ ID NO: 43411 - DNA, 25 bp, Homo sapiens
acgaccttcctgaagatggcagact

SEQ ID NO: 43412 - DNA, 23 bp, Homo sapiens
ccaggtcacacagccagggaagc

SEQ ID NO: 43413 - DNA, 23 bp, Homo sapiens
gtggtcctgtcggtgctgctgtg

SEQ ID NO: 43414 - DNA, 25 bp, Homo sapiens
acttccacaactatggcacatcagc

SEQ ID NO: 43415 - DNA, 25 bp, Homo sapiens
gcatcctgagctatccaacaccact

SEQ ID NO: 43416 - DNA, 24 bp, Homo sapiens
acccctttcaggaacccccaaaga

SEQ ID NO: 43417 - DNA, 24 bp, Homo sapiens
tacccctttcaggaacccccaaag

SEQ ID NO: 43418 - DNA, 24 bp, Homo sapiens
atacccctttcaggaacccccaaa

SEQ ID NO: 43419 - DNA, 24 bp, Homo sapiens
aagtgaaaaagctggtgatcagag

SEQ ID NO: 43420 - DNA, 24 bp, Homo sapiens
caagtgaaaaagctggtgatcaga

SEQ ID NO: 43421 - DNA, 24 bp, Homo sapiens
acaagtgaaaaagctggtgatcag

SEQ ID NO: 43422 - DNA, 25 bp, Homo sapiens
ccacttcacagaatcaaggaggctt

SEQ ID NO: 43423 - DNA, 23 bp, Homo sapiens
gcagccttgacctcctgaactca

SEQ ID NO: 43424 - DNA, 25 bp, Homo sapiens
gggaggaggaatcagcaaagatggt

SEQ ID NO: 43425 - DNA, 23 bp, Homo sapiens
ggattcttggctggctgtgctgt

SEQ ID NO: 43426 - DNA, 25 bp, Homo sapiens
cctagcgtatccattccagagtctt

SEQ ID NO: 43427 - DNA, 25 bp, Homo sapiens
tgacagaatccacctttacacacct

SEQ ID NO: 43428 - DNA, 25 bp, Homo sapiens
cctagcgtatccattccagagtctt

SEQ ID NO: 43429 - DNA, 23 bp, Homo sapiens
ggattcttggctggctgtgctgt

SEQ ID NO: 43430 - DNA, 25 bp, Homo sapiens
cgggctttcaggatgattggtctct

SEQ ID NO: 43431 - DNA, 24 bp, Homo sapiens
ttgaaaaatatgtaagttttatct

SEQ ID NO: 43432 - DNA, 24 bp, Homo sapiens
attgaaaaatatgtaagttttatc

SEQ ID NO: 43433 - DNA, 24 bp, Homo sapiens
cattgaaaaatatgtaagttttat

SEQ ID NO: 43434 - DNA, 24 bp, Homo sapiens
ctttcgaatcgcaaaatttgaaaa

SEQ ID NO: 43435 - DNA, 24 bp, Homo sapiens
cctttcgaatcgcaaaatttgaaa

SEQ ID NO: 43436 - DNA, 24 bp, Homo sapiens
ccctttcgaatcgcaaaatttgaa

SEQ ID NO: 43437 - DNA, 24 bp, Homo sapiens
tcaaatttcaggaaacagaatcca

SEQ ID NO: 43438 - DNA, 24 bp, Homo sapiens
ctcaaatttcaggaaacagaatcc

SEQ ID NO: 43439 - DNA, 24 bp, Homo sapiens
gctcaaatttcaggaaacagaatc

SEQ ID NO: 43440 - DNA, 23 bp, Homo sapiens
tgaggaggacgtggaggaggaga

SEQ ID NO: 43441 - DNA, 23 bp, Homo sapiens
tgttgcctcgctctccttccgta

SEQ ID NO: 43442 - DNA, 25 bp, Homo sapiens
ccatgattgtgtctgaccagatccg

SEQ ID NO: 43443 - DNA, 24 bp, Homo sapiens
tttatatgcaggacttcttaatta

SEQ ID NO: 43444 - DNA, 24 bp, Homo sapiens
ttttatatgcaggacttcttaatt

SEQ ID NO: 43445 - DNA, 24 bp, Homo sapiens
tttttatatgcaggacttcttaat

SEQ ID NO: 43446 - DNA, 24 bp, Homo sapiens
tgcatgtacaggtcagagcaggag

SEQ ID NO: 43447 - DNA, 24 bp, Homo sapiens
ctgcatgtacaggtcagagcagga

SEQ ID NO: 43448 - DNA, 24 bp, Homo sapiens
cctgcatgtacaggtcagagcagg

SEQ ID NO: 43449 - DNA, 24 bp, Homo sapiens
ccacggaagacatcacgctcatca

SEQ ID NO: 43450 - DNA, 24 bp, Homo sapiens
tggtcattgtgcttacgtcggtcg

SEQ ID NO: 43451 - DNA, 24 bp, Homo sapiens
cagtgttggggctgctggcatccc

SEQ ID NO: 43452 - DNA, 24 bp, Homo sapiens
ttaatgtctagatccagaatataa

SEQ ID NO: 43453 - DNA, 24 bp, Homo sapiens
tttaatgtctagatccagaatata

SEQ ID NO: 43454 - DNA, 24 bp, Homo sapiens
ttttaatgtctagatccagaatat

SEQ ID NO: 43455 - DNA, 25 bp, Homo sapiens
gaggaagagaagaccagtgccaacc

SEQ ID NO: 43456 - DNA, 23 bp, Homo sapiens
tctgctgggggagatggaggcga

SEQ ID NO: 43457 - DNA, 25 bp, Homo sapiens
tccagaatataagaagtttttagaa

SEQ ID NO: 43458 - DNA, 24 bp, Homo sapiens
taaacttttaggctagtgatacag

SEQ ID NO: 43459 - DNA, 24 bp, Homo sapiens
ttaaacttttaggctagtgataca

SEQ ID NO: 43460 - DNA, 24 bp, Homo sapiens
tttaaacttttaggctagtgatac

SEQ ID NO: 43461 - DNA, 25 bp, Homo sapiens
gaagagactgaactgaagacgctgc

SEQ ID NO: 43462 - DNA, 24 bp, Homo sapiens
tgaggacaggcacaaacgcaaaga

SEQ ID NO: 43463 - DNA, 25 bp, Homo sapiens
gtcatcaagaggcagaagtcactca

SEQ ID NO: 43464 - DNA, 24 bp, Homo sapiens
gaggtcgtttacaagtcagagccg

SEQ ID NO: 43465 - DNA, 24 bp, Homo sapiens
catcgtcttcttctctgccaccat

SEQ ID NO: 43466 - DNA, 24 bp, Homo sapiens
atgaagatcgtggcggtggctgtg

SEQ ID NO: 43467 - DNA, 24 bp, Homo sapiens
atgaagatcgtggcggtggctgtg

SEQ ID NO: 43468 - DNA, 24 bp, Homo sapiens
ccttcggcattgtgttcctcattg

SEQ ID NO: 43469 - DNA, 24 bp, Homo sapiens
cctgctctacttcttcatcaccaa

SEQ ID NO: 43470 - DNA, 24 bp, Homo sapiens
cgggtcttggcacacctagctccc

SEQ ID NO: 43471 - DNA, 24 bp, Homo sapiens
acgggtcttggcacacctagctcc

SEQ ID NO: 43472 - DNA, 24 bp, Homo sapiens
aacgggtcttggcacacctagctc

SEQ ID NO: 43473 - DNA, 24 bp, Homo sapiens
gttctgggagccgatggtgtttgt

SEQ ID NO: 43474 - DNA, 24 bp, Homo sapiens
tgccgtactcagttggtgtggttg

SEQ ID NO: 43475 - DNA, 23 bp, Homo sapiens
gctctggtgagtcgtgatggcat

SEQ ID NO: 43476 - DNA, 23 bp, Homo sapiens
gcacggcaggcaggagcttctgg

SEQ ID NO: 43477 - DNA, 23 bp, Homo sapiens
gcctgctggtcaagcgggacttc

SEQ ID NO: 43478 - DNA, 23 bp, Homo sapiens
ggcttcacttgcctgcactgggc

SEQ ID NO: 43479 - DNA, 24 bp, Homo sapiens
aaccagacatgggtccaccgctat

SEQ ID NO: 43480 - DNA, 24 bp, Homo sapiens
catcctgcccaccacgctcaccac

SEQ ID NO: 43481 - DNA, 24 bp, Homo sapiens
ggcatgattggctccttctctgtg

SEQ ID NO: 43482 - DNA, 24 bp, Homo sapiens
ttattagtcaggcttgaaaagact

SEQ ID NO: 43483 - DNA, 24 bp, Homo sapiens
cttattagtcaggcttgaaaagac

SEQ ID NO: 43484 - DNA, 24 bp, Homo sapiens
tcttattagtcaggcttgaaaaga

SEQ ID NO: 43485 - DNA, 24 bp, Homo sapiens
tcatgaccttctgcgccgtgttcg

SEQ ID NO: 43486 - DNA, 24 bp, Homo sapiens
ctgggtcggaggctgctgctgctg

SEQ ID NO: 43487 - DNA, 24 bp, Homo sapiens
ttctccatctgcctcatagcctgc

SEQ ID NO: 43488 - DNA, 24 bp, Homo sapiens
aaaatacattattaagtgtgtatg

SEQ ID NO: 43489 - DNA, 24 bp, Homo sapiens
gaaaatacattattaagtgtgtat

SEQ ID NO: 43490 - DNA, 24 bp, Homo sapiens
agaaaatacattattaagtgtgta

SEQ ID NO: 43491 - DNA, 23 bp, Homo sapiens
caggctggtcttcaactcttggc

SEQ ID NO: 43492 - DNA, 25 bp, Homo sapiens
ccagaatgccgagatgatagagacg

SEQ ID NO: 43493 - DNA, 23 bp, Homo sapiens
ctggctcacattcggaggctggt

SEQ ID NO: 43494 - DNA, 25 bp, Homo sapiens
ccagaatgccgagatgatagagacg

SEQ ID NO: 43495 - DNA, 23 bp, Homo sapiens
caggctggtcttcaactcttggc

SEQ ID NO: 43496 - DNA, 24 bp, Homo sapiens
gcttccaagaatgctgaggttaca

SEQ ID NO: 43497 - DNA, 24 bp, Homo sapiens
tggttattaaggtaaattaagcta

SEQ ID NO: 43498 - DNA, 24 bp, Homo sapiens
ttggttattaaggtaaattaagct

SEQ ID NO: 43499 - DNA, 24 bp, Homo sapiens
tttggttattaaggtaaattaagc

SEQ ID NO: 43500 - DNA, 24 bp, Homo sapiens
gtatgatgatgattgcaaactagc

SEQ ID NO: 43501 - DNA, 24 bp, Homo sapiens
agtatgatgatgattgcaaactag

SEQ ID NO: 43502 - DNA, 24 bp, Homo sapiens
cagtatgatgatgattgcaaacta

SEQ ID NO: 43503 - DNA, 23 bp, Homo sapiens
cacctatcacaacagtttatgct

SEQ ID NO: 43504 - DNA, 23 bp, Homo sapiens
gatggtggctccggatgcagtca

SEQ ID NO: 43505 - DNA, 23 bp, Homo sapiens
cctgtctttagtaaacgaatata

SEQ ID NO: 43506 - DNA, 24 bp, Homo sapiens
ggtgtcggagctgattatgtccac

SEQ ID NO: 43507 - DNA, 24 bp, Homo sapiens
gtggtcttctgcctgctgggtgcc

SEQ ID NO: 43508 - DNA, 24 bp, Homo sapiens
tgttggtgatcggcttctcagggc

SEQ ID NO: 43509 - DNA, 23 bp, Homo sapiens
gtgttgcccaggctggtctccaa

SEQ ID NO: 43510 - DNA, 23 bp, Homo sapiens
gagctggggcgacgaggcgattg

SEQ ID NO: 43511 - DNA, 25 bp, Homo sapiens
actttctgtctctatgtatgtgact

SEQ ID NO: 43512 - DNA, 23 bp, Homo sapiens
ctgggctagctgctggctaccaa

SEQ ID NO: 43513 - DNA, 23 bp, Homo sapiens
tcaagcaatcctcccaccttggc

SEQ ID NO: 43514 - DNA, 23 bp, Homo sapiens
gtgcctactctgattttgaactc

SEQ ID NO: 43515 - DNA, 24 bp, Homo sapiens
cctcccaccaggcccgcaagccct

SEQ ID NO: 43516 - DNA, 24 bp, Homo sapiens
acctcccaccaggcccgcaagccc

SEQ ID NO: 43517 - DNA, 24 bp, Homo sapiens
cacctcccaccaggcccgcaagcc

SEQ ID NO: 43518 - DNA, 25 bp, Homo sapiens
ttgaggatgaaggagtcttggacaa

SEQ ID NO: 43519 - DNA, 23 bp, Homo sapiens
cactgagaccaccacgaggcaca

SEQ ID NO: 43520 - DNA, 23 bp, Homo sapiens
gcggctcgtccactccaatgatg

SEQ ID NO: 43521 - DNA, 23 bp, Homo sapiens
tgcccaagacctcagcctcccag

SEQ ID NO: 43522 - DNA, 25 bp, Homo sapiens
gccgagaagaagaaagagctgatga

SEQ ID NO: 43523 - DNA, 23 bp, Homo sapiens
aaggccatgattgagaagctgga

SEQ ID NO: 43524 - DNA, 24 bp, Homo sapiens
agtaaaaaaaggcaaagaagaaga

SEQ ID NO: 43525 - DNA, 24 bp, Homo sapiens
cagtaaaaaaaggcaaagaagaag

SEQ ID NO: 43526 - DNA, 24 bp, Homo sapiens
acagtaaaaaaaggcaaagaagaa

SEQ ID NO: 43527 - DNA, 24 bp, Homo sapiens
aaaggcattaagtgagtattattt

SEQ ID NO: 43528 - DNA, 24 bp, Homo sapiens
gaaaggcattaagtgagtattatt

SEQ ID NO: 43529 - DNA, 24 bp, Homo sapiens
ggaaaggcattaagtgagtattat

SEQ ID NO: 43530 - DNA, 24 bp, Homo sapiens
gaaaattatagcgatctttcagtg

SEQ ID NO: 43531 - DNA, 24 bp, Homo sapiens
ggaaaattatagcgatctttcagt

SEQ ID NO: 43532 - DNA, 24 bp, Homo sapiens
tggaaaattatagcgatctttcag

SEQ ID NO: 43533 - DNA, 23 bp, Homo sapiens
ttagcggcagcggcggcgggttc

SEQ ID NO: 43534 - DNA, 23 bp, Homo sapiens
cctttcctgccggatgtgtgggc

SEQ ID NO: 43535 - DNA, 23 bp, Homo sapiens
ggcgagcagcgttgctggtgttg

SEQ ID NO: 43536 - DNA, 24 bp, Homo sapiens
tttcttctcaggatatttgttctt

SEQ ID NO: 43537 - DNA, 24 bp, Homo sapiens
ttttcttctcaggatatttgttct

SEQ ID NO: 43538 - DNA, 24 bp, Homo sapiens
gttttcttctcaggatatttgttc

SEQ ID NO: 43539 - DNA, 24 bp, Homo sapiens
agaaagatcaggaggattatatgc

SEQ ID NO: 43540 - DNA, 24 bp, Homo sapiens
gagaaagatcaggaggattatatg

SEQ ID NO: 43541 - DNA, 24 bp, Homo sapiens
agagaaagatcaggaggattatat

SEQ ID NO: 43542 - DNA, 24 bp, Homo sapiens
aaatggtggcggtgccttcctggt

SEQ ID NO: 43543 - DNA, 24 bp, Homo sapiens
aaaatggtggcggtgccttcctgg

SEQ ID NO: 43544 - DNA, 24 bp, Homo sapiens
aaaaatggtggcggtgccttcctg

SEQ ID NO: 43545 - DNA, 24 bp, Homo sapiens
cttcgggcaaggtggtgtatttca

SEQ ID NO: 43546 - DNA, 24 bp, Homo sapiens
tcttcgggcaaggtggtgtatttc

SEQ ID NO: 43547 - DNA, 24 bp, Homo sapiens
gtcttcgggcaaggtggtgtattt

SEQ ID NO: 43548 - DNA, 25 bp, Homo sapiens
acttcatcatgctcatcttctgcgg

SEQ ID NO: 43549 - DNA, 24 bp, Homo sapiens
ggctatggtatgatggtggtgtcc

SEQ ID NO: 43550 - DNA, 25 bp, Homo sapiens
atcggcatctactacaatgtggtca

SEQ ID NO: 43551 - DNA, 24 bp, Homo sapiens
ggctatggtatgatggtggtgtcc

SEQ ID NO: 43552 - DNA, 25 bp, Homo sapiens
atcggcatctactacaatgtggtca

SEQ ID NO: 43553 - DNA, 25 bp, Homo sapiens
cgccttctactacttcttctcgtcc

SEQ ID NO: 43554 - DNA, 24 bp, Homo sapiens
catgttcaaaggctgtacgtgctg

SEQ ID NO: 43555 - DNA, 24 bp, Homo sapiens
ccatgttcaaaggctgtacgtgct

SEQ ID NO: 43556 - DNA, 24 bp, Homo sapiens
cccatgttcaaaggctgtacgtgc

SEQ ID NO: 43557 - DNA, 24 bp, Homo sapiens
acactccgctgacctacaacaaga

SEQ ID NO: 43558 - DNA, 24 bp, Homo sapiens
ggctggctcctggctctgtcctcc

SEQ ID NO: 43559 - DNA, 24 bp, Homo sapiens
tggagcctctacagactcggaacc

SEQ ID NO: 43560 - DNA, 24 bp, Homo sapiens
ctaaccgcagcctccactcctctc

SEQ ID NO: 43561 - DNA, 24 bp, Homo sapiens
gccgagcgtccgttggtccttgag

SEQ ID NO: 43562 - DNA, 24 bp, Homo sapiens
agtctgtctgttcgcgatcctgcc

SEQ ID NO: 43563 - DNA, 24 bp, Homo sapiens
ttttcagaaagacaggaagctgac

SEQ ID NO: 43564 - DNA, 24 bp, Homo sapiens
gttttcagaaagacaggaagctga

SEQ ID NO: 43565 - DNA, 24 bp, Homo sapiens
agttttcagaaagacaggaagctg

SEQ ID NO: 43566 - DNA, 24 bp, Homo sapiens
gaagagcccacccagaagccagag

SEQ ID NO: 43567 - DNA, 24 bp, Homo sapiens
ctcttccgctggcagtggcacgag

SEQ ID NO: 43568 - DNA, 24 bp, Homo sapiens
ccctacctggtggccctgtggatc

SEQ ID NO: 43569 - DNA, 24 bp, Homo sapiens
cgccacttcatctcagaggatgcg

SEQ ID NO: 43570 - DNA, 24 bp, Homo sapiens
aggacaaggaggtcttccagcaga

SEQ ID NO: 43571 - DNA, 24 bp, Homo sapiens
gcggcggctggagtcctttaagtc

SEQ ID NO: 43572 - DNA, 24 bp, Homo sapiens
agtatctgtaggtaaatagtttca

SEQ ID NO: 43573 - DNA, 24 bp, Homo sapiens
cagtatctgtaggtaaatagtttc

SEQ ID NO: 43574 - DNA, 24 bp, Homo sapiens
gcagtatctgtaggtaaatagttt

SEQ ID NO: 43575 - DNA, 24 bp, Homo sapiens
ttactaaaagctttatatgaaatt

SEQ ID NO: 43576 - DNA, 24 bp, Homo sapiens
gttactaaaagctttatatgaaat

SEQ ID NO: 43577 - DNA, 24 bp, Homo sapiens
tgttactaaaagctttatatgaaa

SEQ ID NO: 43578 - DNA, 24 bp, Homo sapiens
atcatcatcctgctgtcggtcacg

SEQ ID NO: 43579 - DNA, 24 bp, Homo sapiens
gcctctccatctcagccatctcca

SEQ ID NO: 43580 - DNA, 24 bp, Homo sapiens
tggcacctacttcctcatctcccg

SEQ ID NO: 43581 - DNA, 24 bp, Homo sapiens
cataactccgtggtgctgggctgg

SEQ ID NO: 43582 - DNA, 24 bp, Homo sapiens
ccgtgcctggaagaccttcattga

SEQ ID NO: 43583 - DNA, 24 bp, Homo sapiens
ctcgtgcccaagaacatcgccttc

SEQ ID NO: 43584 - DNA, 24 bp, Homo sapiens
aatggaatcagatttgtaaatact

SEQ ID NO: 43585 - DNA, 24 bp, Homo sapiens
aaatggaatcagatttgtaaatac

SEQ ID NO: 43586 - DNA, 24 bp, Homo sapiens
aaaatggaatcagatttgtaaata

SEQ ID NO: 43587 - DNA, 24 bp, Homo sapiens
ttctgtttcagatttgtaaatact

SEQ ID NO: 43588 - DNA, 24 bp, Homo sapiens
tttctgtttcagatttgtaaatac

SEQ ID NO: 43589 - DNA, 24 bp, Homo sapiens
ttttctgtttcagatttgtaaata

SEQ ID NO: 43590 - DNA, 24 bp, Homo sapiens
tcttcttcatcgtggtcaatgagt

SEQ ID NO: 43591 - DNA, 24 bp, Homo sapiens
tcacacagtttctttggttatccc

SEQ ID NO: 43592 - DNA, 24 bp, Homo sapiens
ggagccctgggagccgccgccatg

SEQ ID NO: 43593 - DNA, 24 bp, Homo sapiens
agatttaggcatcggagtaaggca

SEQ ID NO: 43594 - DNA, 24 bp, Homo sapiens
actggctggactgggctaaagaga

SEQ ID NO: 43595 - DNA, 24 bp, Homo sapiens
agatggttacgagggtgatgttcc

SEQ ID NO: 43596 - DNA, 24 bp, Homo sapiens
ttattactaatgtaagtagctcac

SEQ ID NO: 43597 - DNA, 24 bp, Homo sapiens
gttattactaatgtaagtagctca

SEQ ID NO: 43598 - DNA, 24 bp, Homo sapiens
tgttattactaatgtaagtagctc

SEQ ID NO: 43599 - DNA, 24 bp, Homo sapiens
ctggtacagtcttgtcattcgtga

SEQ ID NO: 43600 - DNA, 24 bp, Homo sapiens
tctacactgagcattctgtgcagg

SEQ ID NO: 43601 - DNA, 24 bp, Homo sapiens
tcacttccacctgaaatatcacaa

SEQ ID NO: 43602 - DNA, 24 bp, Homo sapiens
ggaacaagcaaacgaggcagcgag

SEQ ID NO: 43603 - DNA, 24 bp, Homo sapiens
ccaccacgtcacgcacacgctcgg

SEQ ID NO: 43604 - DNA, 24 bp, Homo sapiens
gcgacgtgactggctagctgcgtg

SEQ ID NO: 43605 - DNA, 24 bp, Homo sapiens
aatatatgtcaaatgggctcctcc

SEQ ID NO: 43606 - DNA, 24 bp, Homo sapiens
tgttgtcctacggagagaggctgg

SEQ ID NO: 43607 - DNA, 24 bp, Homo sapiens
gcccagccctcaggtcctacacag

SEQ ID NO: 43608 - DNA, 24 bp, Homo sapiens
cgccatgaaccactgcctgccaag

SEQ ID NO: 43609 - DNA, 24 bp, Homo sapiens
tcacaggaccttccctaagagccc

SEQ ID NO: 43610 - DNA, 24 bp, Homo sapiens
ctggtgctggtggtggtattcgtc

SEQ ID NO: 43611 - DNA, 24 bp, Homo sapiens
tcttcaacaacaacaccgtggctg

SEQ ID NO: 43612 - DNA, 24 bp, Homo sapiens
gtcggtggctgtgttccctaatcg

SEQ ID NO: 43613 - DNA, 24 bp, Homo sapiens
tgtcctacctcattggcaccaacc

SEQ ID NO: 43614 - DNA, 24 bp, Homo sapiens
agggtccatctgctttgccaacat

SEQ ID NO: 43615 - DNA, 24 bp, Homo sapiens
aaaaattgaacgtaagtaataact

SEQ ID NO: 43616 - DNA, 24 bp, Homo sapiens
gaaaaattgaacgtaagtaataac

SEQ ID NO: 43617 - DNA, 24 bp, Homo sapiens
agaaaaattgaacgtaagtaataa

SEQ ID NO: 43618 - DNA, 24 bp, Homo sapiens
gttttctttaggcaaattacaaaa

SEQ ID NO: 43619 - DNA, 24 bp, Homo sapiens
tgttttctttaggcaaattacaaa

SEQ ID NO: 43620 - DNA, 24 bp, Homo sapiens
ttgttttctttaggcaaattacaa

SEQ ID NO: 43621 - DNA, 24 bp, Homo sapiens
gcagcgacacctctactagccgag

SEQ ID NO: 43622 - DNA, 24 bp, Homo sapiens
ggctcctgcccaagctcggcgtgt

SEQ ID NO: 43623 - DNA, 24 bp, Homo sapiens
ccactccgcgcccggccagccgcc

SEQ ID NO: 43624 - DNA, 23 bp, Homo sapiens
ttgtgaagtgcctgctatgttac

SEQ ID NO: 43625 - DNA, 23 bp, Homo sapiens
gaaatcacccgtcttctgcgtcg

SEQ ID NO: 43626 - DNA, 24 bp, Homo sapiens
ccttggttatttcacagcacactt

SEQ ID NO: 43627 - DNA, 24 bp, Homo sapiens
gatggttttcgaccaagaaaaaat

SEQ ID NO: 43628 - DNA, 24 bp, Homo sapiens
tgatggttttcgaccaagaaaaaa

SEQ ID NO: 43629 - DNA, 24 bp, Homo sapiens
ctgatggttttcgaccaagaaaaa

SEQ ID NO: 43630 - DNA, 24 bp, Homo sapiens
tgtggatcatgcctgtgccaatgg

SEQ ID NO: 43631 - DNA, 24 bp, Homo sapiens
tgtgtggatggtgtgggcaactac

SEQ ID NO: 43632 - DNA, 24 bp, Homo sapiens
tctgaacccatgtcaacacgaggc

SEQ ID NO: 43633 - DNA, 24 bp, Homo sapiens
cttaaaaatttttacacatacata

SEQ ID NO: 43634 - DNA, 24 bp, Homo sapiens
ccttaaaaatttttacacatacat

SEQ ID NO: 43635 - DNA, 24 bp, Homo sapiens
accttaaaaatttttacacataca

SEQ ID NO: 43636 - DNA, 24 bp, Homo sapiens
acttgagtgagaacgccatccagg

SEQ ID NO: 43637 - DNA, 24 bp, Homo sapiens
gatgacatgaaggagctggagcgg

SEQ ID NO: 43638 - DNA, 24 bp, Homo sapiens
tggagaaccagattggagcagtgg

SEQ ID NO: 43639 - DNA, 24 bp, Homo sapiens
atttgcgactgtaacctcaagtgg

SEQ ID NO: 43640 - DNA, 24 bp, Homo sapiens
aacaagcgcatcgggcagatcaag

SEQ ID NO: 43641 - DNA, 24 bp, Homo sapiens
agtggtgcccgctgtgccagtccc

SEQ ID NO: 43642 - DNA, 24 bp, Homo sapiens
cattccaggcacggaggattacca

SEQ ID NO: 43643 - DNA, 24 bp, Homo sapiens
gcagatcaagagcaagaagttccg

SEQ ID NO: 43644 - DNA, 24 bp, Homo sapiens
tgtaacctcaagtggctggcagac

SEQ ID NO: 43645 - DNA, 24 bp, Homo sapiens
tgaagtcaacagctactcctgcct

SEQ ID NO: 43646 - DNA, 24 bp, Homo sapiens
tctgaacccatgtcaacacgaggc

SEQ ID NO: 43647 - DNA, 24 bp, Homo sapiens
tgtgtggatggtgtgggcaactac

SEQ ID NO: 43648 - DNA, 24 bp, Homo sapiens
cgtgtgcccagccccccactcgga

SEQ ID NO: 43649 - DNA, 24 bp, Homo sapiens
acgtgtgcccagccccccactcgg

SEQ ID NO: 43650 - DNA, 24 bp, Homo sapiens
tacgtgtgcccagccccccactcg

SEQ ID NO: 43651 - DNA, 24 bp, Homo sapiens
tttatcattaggaagactcattga

SEQ ID NO: 43652 - DNA, 24 bp, Homo sapiens
ttttatcattaggaagactcattg

SEQ ID NO: 43653 - DNA, 24 bp, Homo sapiens
tttttatcattaggaagactcatt

SEQ ID NO: 43654 - DNA, 24 bp, Homo sapiens
ttattttctagctttcagagattg

SEQ ID NO: 43655 - DNA, 24 bp, Homo sapiens
attattttctagctttcagagatt

SEQ ID NO: 43656 - DNA, 24 bp, Homo sapiens
tattattttctagctttcagagat

SEQ ID NO: 43657 - DNA, 24 bp, Homo sapiens
tttttccttagttatgaagttgcc

SEQ ID NO: 43658 - DNA, 24 bp, Homo sapiens
ctttttccttagttatgaagttgc

SEQ ID NO: 43659 - DNA, 24 bp, Homo sapiens
tctttttccttagttatgaagttg

SEQ ID NO: 43660 - DNA, 24 bp, Homo sapiens
ttcttgcaaaggtatgtttttaaa

SEQ ID NO: 43661 - DNA, 24 bp, Homo sapiens
attcttgcaaaggtatgtttttaa

SEQ ID NO: 43662 - DNA, 24 bp, Homo sapiens
cattcttgcaaaggtatgttttta

SEQ ID NO: 43663 - DNA, 24 bp, Homo sapiens
tacaaagataggtgagtgtttggt

SEQ ID NO: 43664 - DNA, 24 bp, Homo sapiens
ctacaaagataggtgagtgtttgg

SEQ ID NO: 43665 - DNA, 24 bp, Homo sapiens
actacaaagataggtgagtgtttg

SEQ ID NO: 43666 - DNA, 24 bp, Homo sapiens
aaaaaataaaggtagatattttgt

SEQ ID NO: 43667 - DNA, 24 bp, Homo sapiens
aaaaaaataaaggtagatattttg

SEQ ID NO: 43668 - DNA, 24 bp, Homo sapiens
aaaaaaataaaggtagatattttg

SEQ ID NO: 43669 - DNA, 24 bp, Homo sapiens
agtcttattgatgataacaatgaa

SEQ ID NO: 43670 - DNA, 23 bp, Homo sapiens
tgaaactggaaaatataatggtt

SEQ ID NO: 43671 - DNA, 23 bp, Homo sapiens
cagtgggcagcgttagggaaagg

SEQ ID NO: 43672 - DNA, 24 bp, Homo sapiens
gaggtggctgagatccagatcggt

SEQ ID NO: 43673 - DNA, 23 bp, Homo sapiens
ccccaacagggtagacggtgagg

SEQ ID NO: 43674 - DNA, 23 bp, Homo sapiens
tcctggagtctcgctctgtcacc

SEQ ID NO: 43675 - DNA, 23 bp, Homo sapiens
ggttcaagcgatcctcctgcctc

SEQ ID NO: 43676 - DNA, 24 bp, Homo sapiens
ccaagggacctgcctgtgaagaac

SEQ ID NO: 43677 - DNA, 24 bp, Homo sapiens
aaccatggaaggtaaatgatttaa

SEQ ID NO: 43678 - DNA, 24 bp, Homo sapiens
aaaccatggaaggtaaatgattta

SEQ ID NO: 43679 - DNA, 24 bp, Homo sapiens
aaaaccatggaaggtaaatgattt

SEQ ID NO: 43680 - DNA, 24 bp, Homo sapiens
agaatgaagaggtattttctttgg

SEQ ID NO: 43681 - DNA, 24 bp, Homo sapiens
aagaatgaagaggtattttctttg

SEQ ID NO: 43682 - DNA, 24 bp, Homo sapiens
caagaatgaagaggtattttcttt

SEQ ID NO: 43683 - DNA, 24 bp, Homo sapiens
tgaggaggattatgaggtggatga

SEQ ID NO: 43684 - DNA, 24 bp, Homo sapiens
gaagagccagtcagaagtccagaa

SEQ ID NO: 43685 - DNA, 24 bp, Homo sapiens
cgacaccaacagaatcacggaaga

SEQ ID NO: 43686 - DNA, 24 bp, Homo sapiens
tgaggaggattatgaggtggatga

SEQ ID NO: 43687 - DNA, 24 bp, Homo sapiens
cctcacaagacgatgaagaatggt

SEQ ID NO: 43688 - DNA, 24 bp, Homo sapiens
acgacatcagggaacatttacgga

SEQ ID NO: 43689 - DNA, 24 bp, Homo sapiens
ccctccgacaccaacagaatcacg

SEQ ID NO: 43690 - DNA, 24 bp, Homo sapiens
gaagagccagtcagaagtccagaa

SEQ ID NO: 43691 - DNA, 24 bp, Homo sapiens
tgaggaggattatgaggtggatga

SEQ ID NO: 43692 - DNA, 24 bp, Homo sapiens
cacgcgcacctctgcagccgaagc

SEQ ID NO: 43693 - DNA, 24 bp, Homo sapiens
ccacgcgcacctctgcagccgaag

SEQ ID NO: 43694 - DNA, 24 bp, Homo sapiens
accacgcgcacctctgcagccgaa

SEQ ID NO: 43695 - DNA, 25 bp, Homo sapiens
ctggagtgctgtggctgttcatagg

SEQ ID NO: 43696 - DNA, 23 bp, Homo sapiens
caggctggagtggtgtgatctca

SEQ ID NO: 43697 - DNA, 25 bp, Homo sapiens
ggatgtcactatattgatgctgaac

SEQ ID NO: 43698 - DNA, 23 bp, Homo sapiens
ctggaggagctggaggaggagcg

SEQ ID NO: 43699 - DNA, 23 bp, Homo sapiens
ggtgacaagcctcgtggttctgg

SEQ ID NO: 43700 - DNA, 24 bp, Homo sapiens
gaatgactcggtgtacgcctacgc

SEQ ID NO: 43701 - DNA, 23 bp, Homo sapiens
acttagatgttgcctccacctga

SEQ ID NO: 43702 - DNA, 23 bp, Homo sapiens
ggcggatcacgaggtcaggagat

SEQ ID NO: 43703 - DNA, 24 bp, Homo sapiens
atgcggaattattgctagtggaat

SEQ ID NO: 43704 - DNA, 24 bp, Homo sapiens
gtatccaaagggctgaaaaactta

SEQ ID NO: 43705 - DNA, 24 bp, Homo sapiens
agtatccaaagggctgaaaaactt

SEQ ID NO: 43706 - DNA, 24 bp, Homo sapiens
gagtatccaaagggctgaaaaact

SEQ ID NO: 43707 - DNA, 24 bp, Homo sapiens
gagactcggactcccaggaggaag

SEQ ID NO: 43708 - DNA, 24 bp, Homo sapiens
ctacaacgtgtgcctgggctcggt

SEQ ID NO: 43709 - DNA, 24 bp, Homo sapiens
ggctgctgctgctgctgctgctgg

SEQ ID NO: 43710 - DNA, 24 bp, Homo sapiens
gaggagacaaagtgcatataattg

SEQ ID NO: 43711 - DNA, 24 bp, Homo sapiens
cgaggagacaaagtgcatataatt

SEQ ID NO: 43712 - DNA, 24 bp, Homo sapiens
tcgaggagacaaagtgcatataat

SEQ ID NO: 43713 - DNA, 23 bp, Homo sapiens
ctgctcggcggctccaccacagt

SEQ ID NO: 43714 - DNA, 23 bp, Homo sapiens
ctgcagaggcccggagaacacaa

SEQ ID NO: 43715 - DNA, 23 bp, Homo sapiens
gaggtcaggcgctgtctttcctt

SEQ ID NO: 43716 - DNA, 23 bp, Homo sapiens
gtggacgaacgggagcagatggc

SEQ ID NO: 43717 - DNA, 23 bp, Homo sapiens
gagtggtggccagccagcctgct

SEQ ID NO: 43718 - DNA, 24 bp, Homo sapiens
acaaaaaagcctggggcaataatc

SEQ ID NO: 43719 - DNA, 24 bp, Homo sapiens
agcacttcctgactgttaccttgg

SEQ ID NO: 43720 - DNA, 24 bp, Homo sapiens
gtacaatggcatggtcttggttcc

SEQ ID NO: 43721 - DNA, 23 bp, Homo sapiens
catgagtagctgggattacaggc

SEQ ID NO: 43722 - DNA, 24 bp, Homo sapiens
atgtattagaggtaaattttcttt

SEQ ID NO: 43723 - DNA, 24 bp, Homo sapiens
gatgtattagaggtaaattttctt

SEQ ID NO: 43724 - DNA, 24 bp, Homo sapiens
tgatgtattagaggtaaattttct

SEQ ID NO: 43725 - DNA, 24 bp, Homo sapiens
ggaagcaagacccgagaaggtgtg

SEQ ID NO: 43726 - DNA, 23 bp, Homo sapiens
gaggcggcggagaagaccaagga

SEQ ID NO: 43727 - DNA, 23 bp, Homo sapiens
ccgccaggatggacgtgttcatg

SEQ ID NO: 43728 - DNA, 24 bp, Homo sapiens
gggagcagcaggaggaactcatga

SEQ ID NO: 43729 - DNA, 24 bp, Homo sapiens
cgggagcagcaggaggaactcatg

SEQ ID NO: 43730 - DNA, 24 bp, Homo sapiens
ccgggagcagcaggaggaactcat

SEQ ID NO: 43731 - DNA, 24 bp, Homo sapiens
taaaaaggaagcgaatacagtatg

SEQ ID NO: 43732 - DNA, 24 bp, Homo sapiens
ttaaaaaggaagcgaatacagtat

SEQ ID NO: 43733 - DNA, 24 bp, Homo sapiens
attaaaaaggaagcgaatacagta

SEQ ID NO: 43734 - DNA, 24 bp, Homo sapiens
ggaccagcctggctcactagaagt

SEQ ID NO: 43735 - DNA, 24 bp, Homo sapiens
aggaccagcctggctcactagaag

SEQ ID NO: 43736 - DNA, 24 bp, Homo sapiens
gaggaccagcctggctcactagaa

SEQ ID NO: 43737 - DNA, 24 bp, Homo sapiens
aggctgaggatggaaggtgtggaa

SEQ ID NO: 43738 - DNA, 24 bp, Homo sapiens
caagcagtttgtagttgacattga

SEQ ID NO: 43739 - DNA, 25 bp, Homo sapiens
tgtaagtggaactcagaaggcaaca

SEQ ID NO: 43740 - DNA, 24 bp, Homo sapiens
tgagacgaactacagaacagcacg

SEQ ID NO: 43741 - DNA, 23 bp, Homo sapiens
ggcgttctcagcagcagcaagta

SEQ ID NO: 43742 - DNA, 24 bp, Homo sapiens
agtggtgccatcacagcttactgc

SEQ ID NO: 43743 - DNA, 24 bp, Homo sapiens
cgaacaagtgccaggactggtctg

SEQ ID NO: 43744 - DNA, 25 bp, Homo sapiens
cgttgagagaggttttgctccatca

SEQ ID NO: 43745 - DNA, 24 bp, Homo sapiens
agtggtgccatcacagcttactgc

SEQ ID NO: 43746 - DNA, 24 bp, Homo sapiens
cgaacaagtgccaggactggtctg

SEQ ID NO: 43747 - DNA, 25 bp, Homo sapiens
ccagaatcaacagaactgaagctgc

SEQ ID NO: 43748 - DNA, 25 bp, Homo sapiens
gctagaggaagaagaacaggaggat

SEQ ID NO: 43749 - DNA, 25 bp, Homo sapiens
aagaacaagaccaagagccacagga

SEQ ID NO: 43750 - DNA, 25 bp, Homo sapiens
gcggtggtcagtaaacatcagtctc

SEQ ID NO: 43751 - DNA, 24 bp, Homo sapiens
aagtgctgggattacaggcgtgag

SEQ ID NO: 43752 - DNA, 24 bp, Homo sapiens
tctgaggaatcccttctccctggc

SEQ ID NO: 43753 - DNA, 24 bp, Homo sapiens
cccggccaccagtgctattcttaa

SEQ ID NO: 43754 - DNA, 25 bp, Homo sapiens
agtccttcagccagagttagcacaa

SEQ ID NO: 43755 - DNA, 25 bp, Homo sapiens
gctgtcaccaaggcaatccaagaag

SEQ ID NO: 43756 - DNA, 25 bp, Homo sapiens
aaggtggctgttgtgaatagtctgg

SEQ ID NO: 43757 - DNA, 25 bp, Homo sapiens
ctcttgctgatgacatgattcctgt

SEQ ID NO: 43758 - DNA, 25 bp, Homo sapiens
ccacaaggagttagcgacctactgg

SEQ ID NO: 43759 - DNA, 23 bp, Homo sapiens
aatgtggcaggtgctgtgctggc

SEQ ID NO: 43760 - DNA, 25 bp, Homo sapiens
gagaaacagcgtcagcaaatggagc

SEQ ID NO: 43761 - DNA, 23 bp, Homo sapiens
acagcagcagcagcttctacagc

SEQ ID NO: 43762 - DNA, 25 bp, Homo sapiens
gctccagcaacagatccaggttcaa

SEQ ID NO: 43763 - DNA, 24 bp, Homo sapiens
gcccagctcctcgctccccagttc

SEQ ID NO: 43764 - DNA, 24 bp, Homo sapiens
gccgggccgagccgcggggcgggg

SEQ ID NO: 43765 - DNA, 24 bp, Homo sapiens
gaggagggcaggagtcccagccat

SEQ ID NO: 43766 - DNA, 24 bp, Homo sapiens
ggaggagggcaggagtcccagcca

SEQ ID NO: 43767 - DNA, 24 bp, Homo sapiens
aggaggagggcaggagtcccagcc

SEQ ID NO: 43768 - DNA, 24 bp, Homo sapiens
tttatttctagagaatcatgtcca

SEQ ID NO: 43769 - DNA, 24 bp, Homo sapiens
ttttatttctagagaatcatgtcc

SEQ ID NO: 43770 - DNA, 24 bp, Homo sapiens
attttatttctagagaatcatgtc

SEQ ID NO: 43771 - DNA, 24 bp, Homo sapiens
aagttcaaaagacattcaccatgg

SEQ ID NO: 43772 - DNA, 24 bp, Homo sapiens
caagttcaaaagacattcaccatg

SEQ ID NO: 43773 - DNA, 24 bp, Homo sapiens
tcaagttcaaaagacattcaccat

SEQ ID NO: 43774 - DNA, 24 bp, Homo sapiens
cttggagcatgacctggatgatgt

SEQ ID NO: 43775 - DNA, 25 bp, Homo sapiens
tctcaataagaaggtggctcagcga

SEQ ID NO: 43776 - DNA, 23 bp, Homo sapiens
gctggatggtggacactgaggag

SEQ ID NO: 43777 - DNA, 25 bp, Homo sapiens
cacagttaggaggagcaccaaaccg

SEQ ID NO: 43778 - DNA, 24 bp, Homo sapiens
tgtcagccacacctacaactataa

SEQ ID NO: 43779 - DNA, 25 bp, Homo sapiens
agtccagattccaagtgctgctact

SEQ ID NO: 43780 - DNA, 23 bp, Homo sapiens
aaccagcagcaacagcagccagt

SEQ ID NO: 43781 - DNA, 25 bp, Homo sapiens
agataatttgcctccagttcgtggt

SEQ ID NO: 43782 - DNA, 24 bp, Homo sapiens
agctgtcttcatgtaggcaaggaa

SEQ ID NO: 43783 - DNA, 23 bp, Homo sapiens
aaccagcagcaacagcagccagt

SEQ ID NO: 43784 - DNA, 23 bp, Homo sapiens
aaagcatcttcaagccttggccc

SEQ ID NO: 43785 - DNA, 24 bp, Homo sapiens
gatctggtgaggaaggatattatc

SEQ ID NO: 43786 - DNA, 25 bp, Homo sapiens
gtgccaacctcctatctcatcctgt

SEQ ID NO: 43787 - DNA, 25 bp, Homo sapiens
cactctggttccaatgcttctgaca

SEQ ID NO: 43788 - DNA, 25 bp, Homo sapiens
agaatgatgagtccttgctatgcct

SEQ ID NO: 43789 - DNA, 24 bp, Homo sapiens
ctctgcctgccgcctgcctgcctg

SEQ ID NO: 43790 - DNA, 24 bp, Homo sapiens
cgcggtccttcagactgcccggag

SEQ ID NO: 43791 - DNA, 24 bp, Homo sapiens
gttgcctgtctctaaacccctcca

SEQ ID NO: 43792 - DNA, 25 bp, Homo sapiens
aggttgaagcagaagaataaggaga

SEQ ID NO: 43793 - DNA, 23 bp, Homo sapiens
cgtgctgctgctgctgctccgtg

SEQ ID NO: 43794 - DNA, 25 bp, Homo sapiens
ttagttcagaatccagtcagactct

SEQ ID NO: 43795 - DNA, 24 bp, Homo sapiens
cacatcgctgcgggctcacaaagc

SEQ ID NO: 43796 - DNA, 24 bp, Homo sapiens
acgctcggcggcggcgtgtggcag

SEQ ID NO: 43797 - DNA, 24 bp, Homo sapiens
gcgaccgtgccgcgggagctcgag

SEQ ID NO: 43798 - DNA, 24 bp, Homo sapiens
tcaatgaagaaccgtcaccaggca

SEQ ID NO: 43799 - DNA, 24 bp, Homo sapiens
ctgctggcaccttgatcttggact

SEQ ID NO: 43800 - DNA, 24 bp, Homo sapiens
atattttgcaggaaaactcactac

SEQ ID NO: 43801 - DNA, 24 bp, Homo sapiens
aatattttgcaggaaaactcacta

SEQ ID NO: 43802 - DNA, 24 bp, Homo sapiens
aaatattttgcaggaaaactcact

SEQ ID NO: 43803 - DNA, 24 bp, Homo sapiens
catcacctgtgccataccagttaa

SEQ ID NO: 43804 - DNA, 24 bp, Homo sapiens
cttctcagccaaacgccgaccaag

SEQ ID NO: 43805 - DNA, 24 bp, Homo sapiens
gcagcaggaggaggcagagcacag

SEQ ID NO: 43806 - DNA, 24 bp, Homo sapiens
aaaacagaaaggtaaaaagcagag

SEQ ID NO: 43807 - DNA, 24 bp, Homo sapiens
caaaacagaaaggtaaaaagcaga

SEQ ID NO: 43808 - DNA, 24 bp, Homo sapiens
acaaaacagaaaggtaaaaagcag

SEQ ID NO: 43809 - DNA, 24 bp, Homo sapiens
acatcattgaggaacgggagcagg

SEQ ID NO: 43810 - DNA, 24 bp, Homo sapiens
gacatcattgaggaacgggagcag

SEQ ID NO: 43811 - DNA, 24 bp, Homo sapiens
tgacatcattgaggaacgggagca

SEQ ID NO: 43812 - DNA, 24 bp, Homo sapiens
atccagatgccactgaggacctgc

SEQ ID NO: 43813 - DNA, 24 bp, Homo sapiens
attctacctgttcctcagcaaggc

SEQ ID NO: 43814 - DNA, 24 bp, Homo sapiens
ggatcagtagcattggtggcatgg

SEQ ID NO: 43815 - DNA, 24 bp, Homo sapiens
acttccgcaaggtggaggacctct

SEQ ID NO: 43816 - DNA, 24 bp, Homo sapiens
cacttccgcaaggtggaggacctc

SEQ ID NO: 43817 - DNA, 24 bp, Homo sapiens
tcacttccgcaaggtggaggacct

SEQ ID NO: 43818 - DNA, 24 bp, Homo sapiens
gattcatacaggtgcaaataatgc

SEQ ID NO: 43819 - DNA, 24 bp, Homo sapiens
tgattcatacaggtgcaaataatg

SEQ ID NO: 43820 - DNA, 24 bp, Homo sapiens
atgattcatacaggtgcaaataat

SEQ ID NO: 43821 - DNA, 24 bp, Homo sapiens
gcagctgcccggggtcagcggctg

SEQ ID NO: 43822 - DNA, 24 bp, Homo sapiens
ggcagctgcccggggtcagcggct

SEQ ID NO: 43823 - DNA, 24 bp, Homo sapiens
tggcagctgcccggggtcagcggc

SEQ ID NO: 43824 - DNA, 24 bp, Homo sapiens
agcttctacaggtgaggcctatca

SEQ ID NO: 43825 - DNA, 24 bp, Homo sapiens
tagcttctacaggtgaggcctatc

SEQ ID NO: 43826 - DNA, 24 bp, Homo sapiens
atagcttctacaggtgaggcctat

SEQ ID NO: 43827 - DNA, 24 bp, Homo sapiens
ggaaaccaccgactgacccttggg

SEQ ID NO: 43828 - DNA, 24 bp, Homo sapiens
agacatcagtgtggagacagaaga

SEQ ID NO: 43829 - DNA, 24 bp, Homo sapiens
ggagaagaagtcagccaaggatgc

SEQ ID NO: 43830 - DNA, 24 bp, Homo sapiens
ctcaaccacaggaatatgttctgt

SEQ ID NO: 43831 - DNA, 24 bp, Homo sapiens
gctcaaccacaggaatatgttctg

SEQ ID NO: 43832 - DNA, 24 bp, Homo sapiens
agctcaaccacaggaatatgttct

SEQ ID NO: 43833 - DNA, 24 bp, Homo sapiens
cacagcgtcttctgcctctggaga

SEQ ID NO: 43834 - DNA, 24 bp, Homo sapiens
gacggcagagaacgagagcgagaa

SEQ ID NO: 43835 - DNA, 24 bp, Homo sapiens
cgttcaggaaactgccagggacag

SEQ ID NO: 43836 - DNA, 24 bp, Homo sapiens
cgctaccgctcctccatcaatgac

SEQ ID NO: 43837 - DNA, 24 bp, Homo sapiens
cactggtcgtagatgcggagaagc

SEQ ID NO: 43838 - DNA, 23 bp, Homo sapiens
tgtgaaggcggcaggtctcagtc

SEQ ID NO: 43839 - DNA, 25 bp, Homo sapiens
ggaacatctcttagagcgagcactg

SEQ ID NO: 43840 - DNA, 23 bp, Homo sapiens
gtgacccagcccaaccccagccc

SEQ ID NO: 43841 - DNA, 24 bp, Homo sapiens
gtgttcctgcatgaagccaccgtg

SEQ ID NO: 43842 - DNA, 24 bp, Homo sapiens
caggagccagccccacccgcaccc

SEQ ID NO: 43843 - DNA, 24 bp, Homo sapiens
tgctggaacacagcctgcggcggc

SEQ ID NO: 43844 - DNA, 24 bp, Homo sapiens
gctccaccagatggctgtgatagg

SEQ ID NO: 43845 - DNA, 24 bp, Homo sapiens
ggagcagcagcaacctcaccgagc

SEQ ID NO: 43846 - DNA, 24 bp, Homo sapiens
agcaccaagagtgaatgatccgcc

SEQ ID NO: 43847 - DNA, 24 bp, Homo sapiens
gtatctttcaggcttattcaaacc

SEQ ID NO: 43848 - DNA, 24 bp, Homo sapiens
tgtatctttcaggcttattcaaac

SEQ ID NO: 43849 - DNA, 24 bp, Homo sapiens
ttgtatctttcaggcttattcaaa

SEQ ID NO: 43850 - DNA, 24 bp, Homo sapiens
gttcccatcacattatacactaag

SEQ ID NO: 43851 - DNA, 24 bp, Homo sapiens
agttcccatcacattatacactaa

SEQ ID NO: 43852 - DNA, 24 bp, Homo sapiens
cagttcccatcacattatacacta

SEQ ID NO: 43853 - DNA, 24 bp, Homo sapiens
ctacgagatccaagacgcaactcc

SEQ ID NO: 43854 - DNA, 24 bp, Homo sapiens
gccaagaccattctctacagagca

SEQ ID NO: 43855 - DNA, 24 bp, Homo sapiens
cagcctgggtgacacagcgagact

SEQ ID NO: 43856 - DNA, 24 bp, Homo sapiens
tacttgcataggtaagggttattt

SEQ ID NO: 43857 - DNA, 24 bp, Homo sapiens
atacttgcataggtaagggttatt

SEQ ID NO: 43858 - DNA, 24 bp, Homo sapiens
aatacttgcataggtaagggttat

SEQ ID NO: 43859 - DNA, 24 bp, Homo sapiens
cagaggtacaggggctactgttcc

SEQ ID NO: 43860 - DNA, 24 bp, Homo sapiens
tcagaggtacaggggctactgttc

SEQ ID NO: 43861 - DNA, 24 bp, Homo sapiens
ttcagaggtacaggggctactgtt

SEQ ID NO: 43862 - DNA, 24 bp, Homo sapiens
ttgttctctagtactacagatcaa

SEQ ID NO: 43863 - DNA, 24 bp, Homo sapiens
attgttctctagtactacagatca

SEQ ID NO: 43864 - DNA, 24 bp, Homo sapiens
aattgttctctagtactacagatc

SEQ ID NO: 43865 - DNA, 24 bp, Homo sapiens
ttattcagcaatcagtactgctcc

SEQ ID NO: 43866 - DNA, 24 bp, Homo sapiens
attattcagcaatcagtactgctc

SEQ ID NO: 43867 - DNA, 24 bp, Homo sapiens
aattattcagcaatcagtactgct

SEQ ID NO: 43868 - DNA, 24 bp, Homo sapiens
tcccctttcagcggtgacttccac

SEQ ID NO: 43869 - DNA, 24 bp, Homo sapiens
ctcccctttcagcggtgacttcca

SEQ ID NO: 43870 - DNA, 24 bp, Homo sapiens
cctcccctttcagcggtgacttcc

SEQ ID NO: 43871 - DNA, 24 bp, Homo sapiens
ctgttgctgttgctgtggctgtcg

SEQ ID NO: 43872 - DNA, 24 bp, Homo sapiens
ctgagaagaaagggcggtgattca

SEQ ID NO: 43873 - DNA, 24 bp, Homo sapiens
agccaccctagagacatcgaaact

SEQ ID NO: 43874 - DNA, 24 bp, Homo sapiens
accataagcagcagcacgatccag

SEQ ID NO: 43875 - DNA, 24 bp, Homo sapiens
acttcccagctaatctccacccaa

SEQ ID NO: 43876 - DNA, 24 bp, Homo sapiens
gcccaaaggtctatctactaaact

SEQ ID NO: 43877 - DNA, 24 bp, Homo sapiens
agagctaaacaaaatctctagaag

SEQ ID NO: 43878 - DNA, 24 bp, Homo sapiens
aagagctaaacaaaatctctagaa

SEQ ID NO: 43879 - DNA, 24 bp, Homo sapiens
taagagctaaacaaaatctctaga

SEQ ID NO: 43880 - DNA, 24 bp, Homo sapiens
gtgaaaaagggataatattatatt

SEQ ID NO: 43881 - DNA, 24 bp, Homo sapiens
tgtgaaaaagggataatattatat

SEQ ID NO: 43882 - DNA, 24 bp, Homo sapiens
atgtgaaaaagggataatattata

SEQ ID NO: 43883 - DNA, 24 bp, Homo sapiens
tgtgtgtgcgtgtgtatgtatgtg

SEQ ID NO: 43884 - DNA, 24 bp, Homo sapiens
taatattgctgaaaatgcactgca

SEQ ID NO: 43885 - DNA, 24 bp, Homo sapiens
tttctaaagtaacaaatttggttt

SEQ ID NO: 43886 - DNA, 24 bp, Homo sapiens
gattgaaagagatgagtcattcaa

SEQ ID NO: 43887 - DNA, 24 bp, Homo sapiens
ggattgaaagagatgagtcattca

SEQ ID NO: 43888 - DNA, 24 bp, Homo sapiens
aggattgaaagagatgagtcattc

SEQ ID NO: 43889 - DNA, 24 bp, Homo sapiens
ttatgttaaaggtaaattaatttg

SEQ ID NO: 43890 - DNA, 24 bp, Homo sapiens
cttatgttaaaggtaaattaattt

SEQ ID NO: 43891 - DNA, 24 bp, Homo sapiens
tcttatgttaaaggtaaattaatt

SEQ ID NO: 43892 - DNA, 24 bp, Homo sapiens
tgttttcttagaaaacacaacaaa

SEQ ID NO: 43893 - DNA, 24 bp, Homo sapiens
ttgttttcttagaaaacacaacaa

SEQ ID NO: 43894 - DNA, 24 bp, Homo sapiens
tttgttttcttagaaaacacaaca

SEQ ID NO: 43895 - DNA, 24 bp, Homo sapiens
cagcctgggcaacatagggagacc

SEQ ID NO: 43896 - DNA, 24 bp, Homo sapiens
cgttttgcccgattccgtattggt

SEQ ID NO: 43897 - DNA, 24 bp, Homo sapiens
tacctcagcgtttgtgtatcgggc

SEQ ID NO: 43898 - DNA, 24 bp, Homo sapiens
ttcagatttaccagccacgggagc

SEQ ID NO: 43899 - DNA, 24 bp, Homo sapiens
agccatcttgttctgaggtggacc

SEQ ID NO: 43900 - DNA, 24 bp, Homo sapiens
caacctccagtggcgaccagaatc

SEQ ID NO: 43901 - DNA, 24 bp, Homo sapiens
gaaaatcagaggtctgtaatttac

SEQ ID NO: 43902 - DNA, 24 bp, Homo sapiens
agaaaatcagaggtctgtaattta

SEQ ID NO: 43903 - DNA, 24 bp, Homo sapiens
aagaaaatcagaggtctgtaattt

SEQ ID NO: 43904 - DNA, 24 bp, Homo sapiens
ttcaggagcagcttaaagctgtac

SEQ ID NO: 43905 - DNA, 24 bp, Homo sapiens
cttcaggagcagcttaaagctgta

SEQ ID NO: 43906 - DNA, 24 bp, Homo sapiens
gcttcaggagcagcttaaagctgt

SEQ ID NO: 43907 - DNA, 23 bp, Homo sapiens
aaagatgaaggaaattaagatca

SEQ ID NO: 43908 - DNA, 25 bp, Homo sapiens
gtaattcatcattgcaaagaaatct

SEQ ID NO: 43909 - DNA, 23 bp, Homo sapiens
ggaagaacttctttttcttgatt

SEQ ID NO: 43910 - DNA, 24 bp, Homo sapiens
atgcctgtaatcccagcactttgg

SEQ ID NO: 43911 - DNA, 24 bp, Homo sapiens
taaagcaagaagaccttgtggaag

SEQ ID NO: 43912 - DNA, 24 bp, Homo sapiens
agtttcaggctttccggccaggcg

SEQ ID NO: 43913 - DNA, 24 bp, Homo sapiens
tcgtcaccagcaacagcaacaaga

SEQ ID NO: 43914 - DNA, 24 bp, Homo sapiens
ttcgcttccactcagatcagtcct

SEQ ID NO: 43915 - DNA, 24 bp, Homo sapiens
acctctcctacgactccagtgacc

SEQ ID NO: 43916 - DNA, 24 bp, Homo sapiens
catgatagtggcctgtggcaataa

SEQ ID NO: 43917 - DNA, 24 bp, Homo sapiens
acatgatagtggcctgtggcaata

SEQ ID NO: 43918 - DNA, 24 bp, Homo sapiens
cacatgatagtggcctgtggcaat

SEQ ID NO: 43919 - DNA, 25 bp, Homo sapiens
ctgtgtagatagcgaagtgaagcgg

SEQ ID NO: 43920 - DNA, 23 bp, Homo sapiens
gaccgagcctgaggacgcctata

SEQ ID NO: 43921 - DNA, 25 bp, Homo sapiens
tcacagcttaccagacaggacaaga

SEQ ID NO: 43922 - DNA, 24 bp, Homo sapiens
tggaatgatggggccatcctaggt

SEQ ID NO: 43923 - DNA, 24 bp, Homo sapiens
ctggaatgatggggccatcctagg

SEQ ID NO: 43924 - DNA, 24 bp, Homo sapiens
actggaatgatggggccatcctag

SEQ ID NO: 43925 - DNA, 24 bp, Homo sapiens
agccagccatgggatgccattgac

SEQ ID NO: 43926 - DNA, 24 bp, Homo sapiens
gagccagccatgggatgccattga

SEQ ID NO: 43927 - DNA, 24 bp, Homo sapiens
agagccagccatgggatgccattg

SEQ ID NO: 43928 - DNA, 23 bp, Homo sapiens
ccctcctcgccgccaccgcccag

SEQ ID NO: 43929 - DNA, 24 bp, Homo sapiens
ttccctcccttcgtcccttcttcc

SEQ ID NO: 43930 - DNA, 23 bp, Homo sapiens
ctcccgcttcctttgaccgcctc

SEQ ID NO: 43931 - DNA, 24 bp, Homo sapiens
taaccacttaacctctcagaactg

SEQ ID NO: 43932 - DNA, 23 bp, Homo sapiens
ccctcctcgccgccaccgcccag

SEQ ID NO: 43933 - DNA, 24 bp, Homo sapiens
ttccctcccttcgtcccttcttcc

SEQ ID NO: 43934 - DNA, 24 bp, Homo sapiens
tcctcatcaaatcctcacctaagc

SEQ ID NO: 43935 - DNA, 24 bp, Homo sapiens
gcagcatcaccagcaacaacaaca

SEQ ID NO: 43936 - DNA, 24 bp, Homo sapiens
cagcagcagcagcagcggaggcac

SEQ ID NO: 43937 - DNA, 24 bp, Homo sapiens
ttttaaatcagtaaactaaaaaag

SEQ ID NO: 43938 - DNA, 24 bp, Homo sapiens
tttttaaatcagtaaactaaaaaa

SEQ ID NO: 43939 - DNA, 24 bp, Homo sapiens
ttttttaaatcagtaaactaaaaa

SEQ ID NO: 43940 - DNA, 24 bp, Homo sapiens
tttgcttgcaggatgaagatgagc

SEQ ID NO: 43941 - DNA, 24 bp, Homo sapiens
ttttgcttgcaggatgaagatgag

SEQ ID NO: 43942 - DNA, 24 bp, Homo sapiens
attttgcttgcaggatgaagatga

SEQ ID NO: 43943 - DNA, 25 bp, Homo sapiens
gggatatttgataagaaacttcagt

SEQ ID NO: 43944 - DNA, 23 bp, Homo sapiens
ggtggctcatgcccgtaatccca

SEQ ID NO: 43945 - DNA, 23 bp, Homo sapiens
ggtggctcatgcccgtaatccca

SEQ ID NO: 43946 - DNA, 25 bp, Homo sapiens
ttgataagaaacttcagtgaaggcc

SEQ ID NO: 43947 - DNA, 23 bp, Homo sapiens
tctcactccattgcccaggccag

SEQ ID NO: 43948 - DNA, 23 bp, Homo sapiens
ggtggctcatgcccgtaatccca

SEQ ID NO: 43949 - DNA, 25 bp, Homo sapiens
ttgataagaaacttcagtgaaggcc

SEQ ID NO: 43950 - DNA, 23 bp, Homo sapiens
tcactccattgcccaggccagag

SEQ ID NO: 43951 - DNA, 24 bp, Homo sapiens
cgctctctgacctgctgaaaggga

SEQ ID NO: 43952 - DNA, 24 bp, Homo sapiens
atcccaccgagcccagacaccaag

SEQ ID NO: 43953 - DNA, 24 bp, Homo sapiens
gactgtggtgccgtacttggagga

SEQ ID NO: 43954 - DNA, 24 bp, Homo sapiens
atcccaccgagcccagacaccaag

SEQ ID NO: 43955 - DNA, 24 bp, Homo sapiens
gactgtggtgccgtacttggagga

SEQ ID NO: 43956 - DNA, 24 bp, Homo sapiens
catctacactcaggacttcacggt

SEQ ID NO: 43957 - DNA, 24 bp, Homo sapiens
ggctggagaagtgtcctatgggtc

SEQ ID NO: 43958 - DNA, 24 bp, Homo sapiens
tggctggagaagtgtcctatgggt

SEQ ID NO: 43959 - DNA, 24 bp, Homo sapiens
atggctggagaagtgtcctatggg

SEQ ID NO: 43960 - DNA, 24 bp, Homo sapiens
caagtatgagaccagcggcatcgg

SEQ ID NO: 43961 - DNA, 24 bp, Homo sapiens
gacgaggacgacgacctgtggata

SEQ ID NO: 43962 - DNA, 23 bp, Homo sapiens
cgccacaagcacatcgcagaggt

SEQ ID NO: 43963 - DNA, 24 bp, Homo sapiens
gtgtggagcaggacctggccatgg

SEQ ID NO: 43964 - DNA, 24 bp, Homo sapiens
agtgtggagcaggacctggccatg

SEQ ID NO: 43965 - DNA, 24 bp, Homo sapiens
tagtgtggagcaggacctggccat

SEQ ID NO: 43966 - DNA, 24 bp, Homo sapiens
ccttttttaagtctgtagattgtt

SEQ ID NO: 43967 - DNA, 24 bp, Homo sapiens
accttttttaagtctgtagattgt

SEQ ID NO: 43968 - DNA, 24 bp, Homo sapiens
aaccttttttaagtctgtagattg

SEQ ID NO: 43969 - DNA, 23 bp, Homo sapiens
gagccatcatccaacaccgccat

SEQ ID NO: 43970 - DNA, 24 bp, Homo sapiens
tcaagcaatccacctgcctcaacc

SEQ ID NO: 43971 - DNA, 25 bp, Homo sapiens
agtgccaagattacagacctgctgc

SEQ ID NO: 43972 - DNA, 24 bp, Homo sapiens
tcaagcaatccacctgcctcaacc

SEQ ID NO: 43973 - DNA, 25 bp, Homo sapiens
agtgccaagattacagacctgctgc

SEQ ID NO: 43974 - DNA, 24 bp, Homo sapiens
ggatgaaccacatgcttcctgacc

SEQ ID NO: 43975 - DNA, 23 bp, Homo sapiens
tcactgagttcacctgcgagtca

SEQ ID NO: 43976 - DNA, 24 bp, Homo sapiens
agcagtcctcctgtgtaggtctcc

SEQ ID NO: 43977 - DNA, 25 bp, Homo sapiens
cggaattggtgggttcttggtctca

SEQ ID NO: 43978 - DNA, 23 bp, Homo sapiens
ctcccaaagtgctagtgtgtccg

SEQ ID NO: 43979 - DNA, 25 bp, Homo sapiens
tgggttcttggtctcactgacttca

SEQ ID NO: 43980 - DNA, 23 bp, Homo sapiens
ctggcctctagcagtcctcctgt

SEQ ID NO: 43981 - DNA, 25 bp, Homo sapiens
cggaattggtgggttcttggtctca

SEQ ID NO: 43982 - DNA, 24 bp, Homo sapiens
agcagtcctcctgtgtaggtctcc

SEQ ID NO: 43983 - DNA, 23 bp, Homo sapiens
ctgctggcattgagggacggagt

SEQ ID NO: 43984 - DNA, 24 bp, Homo sapiens
ggtaaacccaggatagaatatgta

SEQ ID NO: 43985 - DNA, 24 bp, Homo sapiens
gggtaaacccaggatagaatatgt

SEQ ID NO: 43986 - DNA, 24 bp, Homo sapiens
ggggtaaacccaggatagaatatg

SEQ ID NO: 43987 - DNA, 24 bp, Homo sapiens
ggaagaggaggaagaggaggcagc

SEQ ID NO: 43988 - DNA, 24 bp, Homo sapiens
gctcctgtcgttgctggtcttctc

SEQ ID NO: 43989 - DNA, 24 bp, Homo sapiens
gctcaagcacatggtcctggtggc

SEQ ID NO: 43990 - DNA, 24 bp, Homo sapiens
ctatgcagagttcgagccgcacat

SEQ ID NO: 43991 - DNA, 24 bp, Homo sapiens
ggtcacgagctgccctgccgcctg

SEQ ID NO: 43992 - DNA, 24 bp, Homo sapiens
ctccaggtctacacccgcggcaaa

SEQ ID NO: 43993 - DNA, 24 bp, Homo sapiens
gcctgatgatccgtcactgtctcc

SEQ ID NO: 43994 - DNA, 24 bp, Homo sapiens
gcaagaaaacaagctcagggctcc

SEQ ID NO: 43995 - DNA, 24 bp, Homo sapiens
cccgccgcagccacctcacccttg

SEQ ID NO: 43996 - DNA, 24 bp, Homo sapiens
caaggacgtgcctggcagcggcct

SEQ ID NO: 43997 - DNA, 24 bp, Homo sapiens
cccggggccagggcagtgccaagg

SEQ ID NO: 43998 - DNA, 24 bp, Homo sapiens
gcccggggccagggcagtgccaag

SEQ ID NO: 43999 - DNA, 24 bp, Homo sapiens
ggcccggggccagggcagtgccaa

SEQ ID NO: 44000 - DNA, 24 bp, Homo sapiens
agaagatccgcgaacaggaatatt

SEQ ID NO: 44001 - DNA, 24 bp, Homo sapiens
aagaagatccgcgaacaggaatat

SEQ ID NO: 44002 - DNA, 24 bp, Homo sapiens
caagaagatccgcgaacaggaata

SEQ ID NO: 44003 - DNA, 24 bp, Homo sapiens
tcttcatagacaaccttgacgagc

SEQ ID NO: 44004 - DNA, 24 bp, Homo sapiens
cccgcatcgctttctttgccacaa

SEQ ID NO: 44005 - DNA, 24 bp, Homo sapiens
tccgggcaggcgaggagctcacct

SEQ ID NO: 44006 - DNA, 24 bp, Homo sapiens
tgtgtctctagagtttcaacaaat

SEQ ID NO: 44007 - DNA, 24 bp, Homo sapiens
ttgtgtctctagagtttcaacaaa

SEQ ID NO: 44008 - DNA, 24 bp, Homo sapiens
tttgtgtctctagagtttcaacaa

SEQ ID NO: 44009 - DNA, 24 bp, Homo sapiens
gtgaagaaaatgtatgttatattt

SEQ ID NO: 44010 - DNA, 24 bp, Homo sapiens
agtgaagaaaatgtatgttatatt

SEQ ID NO: 44011 - DNA, 24 bp, Homo sapiens
gagtgaagaaaatgtatgttatat

SEQ ID NO: 44012 - DNA, 24 bp, Homo sapiens
ttaataaaagagtaagtagtaatt

SEQ ID NO: 44013 - DNA, 24 bp, Homo sapiens
tttaataaaagagtaagtagtaat

SEQ ID NO: 44014 - DNA, 24 bp, Homo sapiens
atttaataaaagagtaagtagtaa

SEQ ID NO: 44015 - DNA, 24 bp, Homo sapiens
ttatatttcagaaaatgataacag

SEQ ID NO: 44016 - DNA, 24 bp, Homo sapiens
tttatatttcagaaaatgataaca

SEQ ID NO: 44017 - DNA, 24 bp, Homo sapiens
ctttatatttcagaaaatgataac

SEQ ID NO: 44018 - DNA, 24 bp, Homo sapiens
agagatgaagttaaatgtaaattg

SEQ ID NO: 44019 - DNA, 24 bp, Homo sapiens
aactagaatatgtgagagaagagc

SEQ ID NO: 44020 - DNA, 24 bp, Homo sapiens
acaaaattcaggaaaaactcaaaa

SEQ ID NO: 44021 - DNA, 24 bp, Homo sapiens
tacaaaattcaggaaaaactcaaa

SEQ ID NO: 44022 - DNA, 24 bp, Homo sapiens
ttacaaaattcaggaaaaactcaa

SEQ ID NO: 44023 - DNA, 24 bp, Homo sapiens
gagcatctttggaaaaactcaaaa

SEQ ID NO: 44024 - DNA, 24 bp, Homo sapiens
agagcatctttggaaaaactcaaa

SEQ ID NO: 44025 - DNA, 24 bp, Homo sapiens
gagagcatctttggaaaaactcaa

SEQ ID NO: 44026 - DNA, 24 bp, Homo sapiens
ttataatcctcatttcctacatat

SEQ ID NO: 44027 - DNA, 24 bp, Homo sapiens
attataatcctcatttcctacata

SEQ ID NO: 44028 - DNA, 24 bp, Homo sapiens
tattataatcctcatttcctacat

SEQ ID NO: 44029 - DNA, 25 bp, Homo sapiens
gaccaccaggatgaagacaaacagc

SEQ ID NO: 44030 - DNA, 24 bp, Homo sapiens
gctcgtggtcaacaagatggctca

SEQ ID NO: 44031 - DNA, 23 bp, Homo sapiens
ccagacctcccagcagcccgcag

SEQ ID NO: 44032 - DNA, 23 bp, Homo sapiens
gccaaggtgctgctggtggtcga

SEQ ID NO: 44033 - DNA, 23 bp, Homo sapiens
ttcttcagctcgctgtcccaagc

SEQ ID NO: 44034 - DNA, 23 bp, Homo sapiens
cgcccgctcccgcgcccgcagcc

SEQ ID NO: 44035 - DNA, 24 bp, Homo sapiens
aagaccgagagtgacctcagcatc

SEQ ID NO: 44036 - DNA, 24 bp, Homo sapiens
gggtcttcgccatcttcgcctttg

SEQ ID NO: 44037 - DNA, 24 bp, Homo sapiens
attgctgatgctgctgctggcgga

SEQ ID NO: 44038 - DNA, 24 bp, Homo sapiens
acatagacaaggtgcagccagaag

SEQ ID NO: 44039 - DNA, 24 bp, Homo sapiens
tacatagacaaggtgcagccagaa

SEQ ID NO: 44040 - DNA, 24 bp, Homo sapiens
ttacatagacaaggtgcagccaga

SEQ ID NO: 44041 - DNA, 24 bp, Homo sapiens
ttgtttttcagatcacagctctta

SEQ ID NO: 44042 - DNA, 24 bp, Homo sapiens
cttgtttttcagatcacagctctt

SEQ ID NO: 44043 - DNA, 24 bp, Homo sapiens
tcttgtttttcagatcacagctct

SEQ ID NO: 44044 - DNA, 24 bp, Homo sapiens
aggtggatctcaggtagcgagtct

SEQ ID NO: 44045 - DNA, 24 bp, Homo sapiens
gtaccgagtggaccacctgctgag

SEQ ID NO: 44046 - DNA, 24 bp, Homo sapiens
ctggaggagagcgagctgtggctg

SEQ ID NO: 44047 - DNA, 24 bp, Homo sapiens
tttaaattctgtggcttatgaaag

SEQ ID NO: 44048 - DNA, 24 bp, Homo sapiens
ctttaaattctgtggcttatgaaa

SEQ ID NO: 44049 - DNA, 24 bp, Homo sapiens
gctttaaattctgtggcttatgaa

SEQ ID NO: 44050 - DNA, 24 bp, Homo sapiens
ccaagaagaaggtgggcgcggggg

SEQ ID NO: 44051 - DNA, 24 bp, Homo sapiens
gccaagaagaaggtgggcgcgggg

SEQ ID NO: 44052 - DNA, 24 bp, Homo sapiens
ggccaagaagaaggtgggcgcggg

SEQ ID NO: 44053 - DNA, 24 bp, Homo sapiens
ccactgtgcttgggctgctggagt

SEQ ID NO: 44054 - DNA, 24 bp, Homo sapiens
tccactgtgcttgggctgctggag

SEQ ID NO: 44055 - DNA, 24 bp, Homo sapiens
gtccactgtgcttgggctgctgga

SEQ ID NO: 44056 - DNA, 24 bp, Homo sapiens
gaggctcccactctcagaccccga

SEQ ID NO: 44057 - DNA, 24 bp, Homo sapiens
acagccgcccgccgcccagcacag

SEQ ID NO: 44058 - DNA, 24 bp, Homo sapiens
gggaacccgccggggagaggcacc

SEQ ID NO: 44059 - DNA, 24 bp, Homo sapiens
atttcattgaggaatttgacaatt

SEQ ID NO: 44060 - DNA, 24 bp, Homo sapiens
gatttcattgaggaatttgacaat

SEQ ID NO: 44061 - DNA, 24 bp, Homo sapiens
agatttcattgaggaatttgacaa

SEQ ID NO: 44062 - DNA, 24 bp, Homo sapiens
atgaaataatggatgtagccaatc

SEQ ID NO: 44063 - DNA, 24 bp, Homo sapiens
tatgaaataatggatgtagccaat

SEQ ID NO: 44064 - DNA, 24 bp, Homo sapiens
ttatgaaataatggatgtagccaa

SEQ ID NO: 44065 - DNA, 24 bp, Homo sapiens
taagtataatggacctgagagtca

SEQ ID NO: 44066 - DNA, 24 bp, Homo sapiens
ttaagtataatggacctgagagtc

SEQ ID NO: 44067 - DNA, 24 bp, Homo sapiens
gttaagtataatggacctgagagt

SEQ ID NO: 44068 - DNA, 24 bp, Homo sapiens
gaatgatagaggaatttaggaaac

SEQ ID NO: 44069 - DNA, 24 bp, Homo sapiens
agaatgatagaggaatttaggaaa

SEQ ID NO: 44070 - DNA, 24 bp, Homo sapiens
tagaatgatagaggaatttaggaa

SEQ ID NO: 44071 - DNA, 24 bp, Homo sapiens
ggaaaaataagttttcagataact

SEQ ID NO: 44072 - DNA, 24 bp, Homo sapiens
aggaaaaataagttttcagataac

SEQ ID NO: 44073 - DNA, 24 bp, Homo sapiens
caggaaaaataagttttcagataa

SEQ ID NO: 44074 - DNA, 24 bp, Homo sapiens
cccgccgcgccctcgccccccgcc

SEQ ID NO: 44075 - DNA, 24 bp, Homo sapiens
cccccttcgtgggcgccgccgcgc

SEQ ID NO: 44076 - DNA, 24 bp, Homo sapiens
agaatggcgtgattctgagcaagc

SEQ ID NO: 44077 - DNA, 24 bp, Homo sapiens
aagaatggcgtgattctgagcaag

SEQ ID NO: 44078 - DNA, 24 bp, Homo sapiens
gaagaatggcgtgattctgagcaa

SEQ ID NO: 44079 - DNA, 24 bp, Homo sapiens
aaccacaactaaaactggaaatgt

SEQ ID NO: 44080 - DNA, 24 bp, Homo sapiens
ttgagaaaacagggaatacattgt

SEQ ID NO: 44081 - DNA, 24 bp, Homo sapiens
tgtgtaaaaacaacaaaaacaaac

SEQ ID NO: 44082 - DNA, 24 bp, Homo sapiens
agtttttgaaggtagtaattacag

SEQ ID NO: 44083 - DNA, 24 bp, Homo sapiens
aagtttttgaaggtagtaattaca

SEQ ID NO: 44084 - DNA, 24 bp, Homo sapiens
gaagtttttgaaggtagtaattac

SEQ ID NO: 44085 - DNA, 25 bp, Homo sapiens
tcccaggtcctcaactttgaagaga

SEQ ID NO: 44086 - DNA, 23 bp, Homo sapiens
gcctcctcctcctcctcgtcttc

SEQ ID NO: 44087 - DNA, 23 bp, Homo sapiens
ggctccaggctgagggtcggtcc

SEQ ID NO: 44088 - DNA, 24 bp, Homo sapiens
ggtcccatcacataccctggagga

SEQ ID NO: 44089 - DNA, 24 bp, Homo sapiens
tagccaggatggtctggatctcct

SEQ ID NO: 44090 - DNA, 24 bp, Homo sapiens
acttgcttttctaattgtgggtcc

SEQ ID NO: 44091 - DNA, 24 bp, Homo sapiens
tgcacaggcaggtggctgcagtgg

SEQ ID NO: 44092 - DNA, 24 bp, Homo sapiens
ctgcacaggcaggtggctgcagtg

SEQ ID NO: 44093 - DNA, 24 bp, Homo sapiens
cctgcacaggcaggtggctgcagt

SEQ ID NO: 44094 - DNA, 24 bp, Homo sapiens
tctcttttcagaccatattttaca

SEQ ID NO: 44095 - DNA, 24 bp, Homo sapiens
ttctcttttcagaccatattttac

SEQ ID NO: 44096 - DNA, 24 bp, Homo sapiens
attctcttttcagaccatatttta

SEQ ID NO: 44097 - DNA, 24 bp, Homo sapiens
tgctagatgtggagaaagtgtcac

SEQ ID NO: 44098 - DNA, 24 bp, Homo sapiens
ttgctagatgtggagaaagtgtca

SEQ ID NO: 44099 - DNA, 24 bp, Homo sapiens
tttgctagatgtggagaaagtgtc

SEQ ID NO: 44100 - DNA, 24 bp, Homo sapiens
atgcccaaaagttgttggtgaaaa

SEQ ID NO: 44101 - DNA, 24 bp, Homo sapiens
tatgcccaaaagttgttggtgaaa

SEQ ID NO: 44102 - DNA, 24 bp, Homo sapiens
atatgcccaaaagttgttggtgaa

SEQ ID NO: 44103 - DNA, 24 bp, Homo sapiens
cagcatccacctgccccagccaac

SEQ ID NO: 44104 - DNA, 24 bp, Homo sapiens
cacacacgcgccctcacccgccac

SEQ ID NO: 44105 - DNA, 24 bp, Homo sapiens
cccagacaggggctggcggcccgg

SEQ ID NO: 44106 - DNA, 23 bp, Homo sapiens
gtcgtcatgggcttggtgggcac

SEQ ID NO: 44107 - DNA, 23 bp, Homo sapiens
tgccgccgctcacctggaccctg

SEQ ID NO: 44108 - DNA, 23 bp, Homo sapiens
tcgagcggtcgaggtcgcagacc

SEQ ID NO: 44109 - DNA, 23 bp, Homo sapiens
gtcgtcatgggcttggtgggcac

SEQ ID NO: 44110 - DNA, 23 bp, Homo sapiens
tgccgccgctcacctggaccctg

SEQ ID NO: 44111 - DNA, 23 bp, Homo sapiens
ctctgcacgtgaagtggccgttc

SEQ ID NO: 44112 - DNA, 24 bp, Homo sapiens
gcagcatggaggtaccagcgtggc

SEQ ID NO: 44113 - DNA, 24 bp, Homo sapiens
ggcagcatggaggtaccagcgtgg

SEQ ID NO: 44114 - DNA, 24 bp, Homo sapiens
tggcagcatggaggtaccagcgtg

SEQ ID NO: 44115 - DNA, 24 bp, Homo sapiens
gccaggtgtacgagacattgctca

SEQ ID NO: 44116 - DNA, 23 bp, Homo sapiens
cggagcttgcagtggtgagagag

SEQ ID NO: 44117 - DNA, 23 bp, Homo sapiens
ctgtgtgaccttctgggcgtacc

SEQ ID NO: 44118 - DNA, 24 bp, Homo sapiens
actggtgattgctgcggtgtttga

SEQ ID NO: 44119 - DNA, 23 bp, Homo sapiens
ctgccgccttccaggagaatgtg

SEQ ID NO: 44120 - DNA, 23 bp, Homo sapiens
tgccgtcggtaacagatccaact

SEQ ID NO: 44121 - DNA, 24 bp, Homo sapiens
atctcttacagaaatattgtatcc

SEQ ID NO: 44122 - DNA, 24 bp, Homo sapiens
aatctcttacagaaatattgtatc

SEQ ID NO: 44123 - DNA, 24 bp, Homo sapiens
aaatctcttacagaaatattgtat

SEQ ID NO: 44124 - DNA, 24 bp, Homo sapiens
ttctctttcagtaaagaatatccc

SEQ ID NO: 44125 - DNA, 24 bp, Homo sapiens
tttctctttcagtaaagaatatcc

SEQ ID NO: 44126 - DNA, 24 bp, Homo sapiens
ttttctctttcagtaaagaatatc

SEQ ID NO: 44127 - DNA, 24 bp, Homo sapiens
caaccacagtcctttcagcagcga

SEQ ID NO: 44128 - DNA, 23 bp, Homo sapiens
ctcctgcctccacccaacccata

SEQ ID NO: 44129 - DNA, 25 bp, Homo sapiens
aagaatgttccaccacagaccatcc

SEQ ID NO: 44130 - DNA, 24 bp, Homo sapiens
ggatggtggctggcaatgctgatt

SEQ ID NO: 44131 - DNA, 24 bp, Homo sapiens
gcttctggagacacctggatgaga

SEQ ID NO: 44132 - DNA, 24 bp, Homo sapiens
ttcacccactaagcctgttcctgt

SEQ ID NO: 44133 - DNA, 24 bp, Homo sapiens
gcttctggagacacctggatgaga

SEQ ID NO: 44134 - DNA, 24 bp, Homo sapiens
ggatggtggctggcaatgctgatt

SEQ ID NO: 44135 - DNA, 24 bp, Homo sapiens
cccaagagtttatatacaccctga

SEQ ID NO: 44136 - DNA, 24 bp, Homo sapiens
aaaattattaggtatcattgatct

SEQ ID NO: 44137 - DNA, 24 bp, Homo sapiens
aaaaattattaggtatcattgatc

SEQ ID NO: 44138 - DNA, 24 bp, Homo sapiens
aaaaaattattaggtatcattgat

SEQ ID NO: 44139 - DNA, 24 bp, Homo sapiens
gcggctgctaggggactctgtccg

SEQ ID NO: 44140 - DNA, 24 bp, Homo sapiens
agcggctgctaggggactctgtcc

SEQ ID NO: 44141 - DNA, 24 bp, Homo sapiens
aagcggctgctaggggactctgtc

SEQ ID NO: 44142 - DNA, 24 bp, Homo sapiens
tgtgtctgcggatctgtagtggcg

SEQ ID NO: 44143 - DNA, 24 bp, Homo sapiens
ggttagacatgaacgccgcctcgg

SEQ ID NO: 44144 - DNA, 24 bp, Homo sapiens
gcaggagcaggcggcggcggtggc

SEQ ID NO: 44145 - DNA, 24 bp, Homo sapiens
atttagtgcagatgttttcacctc

SEQ ID NO: 44146 - DNA, 24 bp, Homo sapiens
aatttagtgcagatgttttcacct

SEQ ID NO: 44147 - DNA, 24 bp, Homo sapiens
gaatttagtgcagatgttttcacc

SEQ ID NO: 44148 - DNA, 25 bp, Homo sapiens
gcacctggaggctaaagaactttgg

SEQ ID NO: 44149 - DNA, 23 bp, Homo sapiens
ccgaagaagaggtggaggacgac

SEQ ID NO: 44150 - DNA, 23 bp, Homo sapiens
gggtcaccagccgccgttcttcc

SEQ ID NO: 44151 - DNA, 24 bp, Homo sapiens
gcccggaccagcccagacgaggac

SEQ ID NO: 44152 - DNA, 24 bp, Homo sapiens
ggcccggaccagcccagacgagga

SEQ ID NO: 44153 - DNA, 24 bp, Homo sapiens
gggcccggaccagcccagacgagg

SEQ ID NO: 44154 - DNA, 24 bp, Homo sapiens
gtcttccatcctcggtgtacccac

SEQ ID NO: 44155 - DNA, 24 bp, Homo sapiens
caggtgaggactacggcagggatg

SEQ ID NO: 44156 - DNA, 24 bp, Homo sapiens
ggcagcagtggaagcagcagcacg

SEQ ID NO: 44157 - DNA, 24 bp, Homo sapiens
ggtgggcagcagtggaagcagcag

SEQ ID NO: 44158 - DNA, 24 bp, Homo sapiens
catccccgctgcccctcccgcccg

SEQ ID NO: 44159 - DNA, 24 bp, Homo sapiens
cagccgagctctggagtcccccgg

SEQ ID NO: 44160 - DNA, 24 bp, Homo sapiens
ccatctgcatcctccttctcctca

SEQ ID NO: 44161 - DNA, 24 bp, Homo sapiens
gtctccagccacacgccgcctgtc

SEQ ID NO: 44162 - DNA, 24 bp, Homo sapiens
caagcaataacttctcgtccagcc

SEQ ID NO: 44163 - DNA, 24 bp, Homo sapiens
atattacaatggagaaaaaaaaag

SEQ ID NO: 44164 - DNA, 24 bp, Homo sapiens
aatattacaatggagaaaaaaaaa

SEQ ID NO: 44165 - DNA, 24 bp, Homo sapiens
gaatattacaatggagaaaaaaaa

SEQ ID NO: 44166 - DNA, 24 bp, Homo sapiens
gcccatgacccgtagtttgctgat

SEQ ID NO: 44167 - DNA, 24 bp, Homo sapiens
ctcacacctgtaatcccagcactt

SEQ ID NO: 44168 - DNA, 24 bp, Homo sapiens
aaagggagtcacataggccgggcg

SEQ ID NO: 44169 - DNA, 24 bp, Homo sapiens
cgggatgtgatgctggagaactat

SEQ ID NO: 44170 - DNA, 24 bp, Homo sapiens
atgtggctgtgctgtttacccgag

SEQ ID NO: 44171 - DNA, 24 bp, Homo sapiens
cgggagagccagaaagaggacatg

SEQ ID NO: 44172 - DNA, 23 bp, Homo sapiens
cagcagcagcaaggagtccagtc

SEQ ID NO: 44173 - DNA, 23 bp, Homo sapiens
gcccactgcccacccaagaatag

SEQ ID NO: 44174 - DNA, 23 bp, Homo sapiens
ccgctacacagtgcttgactcct

SEQ ID NO: 44175 - DNA, 23 bp, Homo sapiens
ctctcaggtcggagctgcctcag

SEQ ID NO: 44176 - DNA, 25 bp, Homo sapiens
gaggaatcggacagtgaggaggagg

SEQ ID NO: 44177 - DNA, 23 bp, Homo sapiens
agaagcagcagcgaggagtcaga

SEQ ID NO: 44178 - DNA, 24 bp, Homo sapiens
gaaatgtatgagtaagtatgttta

SEQ ID NO: 44179 - DNA, 24 bp, Homo sapiens
agaaatgtatgagtaagtatgttt

SEQ ID NO: 44180 - DNA, 24 bp, Homo sapiens
tagaaatgtatgagtaagtatgtt

SEQ ID NO: 44181 - DNA, 24 bp, Homo sapiens
agttccctgaggtaggaatgtctg

SEQ ID NO: 44182 - DNA, 24 bp, Homo sapiens
gagttccctgaggtaggaatgtct

SEQ ID NO: 44183 - DNA, 24 bp, Homo sapiens
agagttccctgaggtaggaatgtc

SEQ ID NO: 44184 - DNA, 24 bp, Homo sapiens
gggttctacgggaatacagtgacc

SEQ ID NO: 44185 - DNA, 24 bp, Homo sapiens
ctgctgctgctgtggttggtgtta

SEQ ID NO: 44186 - DNA, 24 bp, Homo sapiens
agcgagttcttgcgggagtgggag

SEQ ID NO: 44187 - DNA, 24 bp, Homo sapiens
gatcaaagaaggtttcatcatgaa

SEQ ID NO: 44188 - DNA, 24 bp, Homo sapiens
agatcaaagaaggtttcatcatga

SEQ ID NO: 44189 - DNA, 24 bp, Homo sapiens
gagatcaaagaaggtttcatcatg

SEQ ID NO: 44190 - DNA, 24 bp, Homo sapiens
gagcctttgcccaggtgtacgaag

SEQ ID NO: 44191 - DNA, 24 bp, Homo sapiens
atggcagtgtattagtaggagagc

SEQ ID NO: 44192 - DNA, 24 bp, Homo sapiens
aagtgatgcctcaaggtcttgtca

SEQ ID NO: 44193 - DNA, 24 bp, Homo sapiens
aacaactttggatatacttttaaa

SEQ ID NO: 44194 - DNA, 24 bp, Homo sapiens
aaacaactttggatatacttttaa

SEQ ID NO: 44195 - DNA, 24 bp, Homo sapiens
gaaacaactttggatatactttta

SEQ ID NO: 44196 - DNA, 24 bp, Homo sapiens
aagaggaacaggtggctgaatttc

SEQ ID NO: 44197 - DNA, 24 bp, Homo sapiens
tcatacagagcacttcagggagca

SEQ ID NO: 44198 - DNA, 24 bp, Homo sapiens
agttgctgacttctcttatggaca

SEQ ID NO: 44199 - DNA, 24 bp, Homo sapiens
ggagccagccacccagagcccgct

SEQ ID NO: 44200 - DNA, 24 bp, Homo sapiens
tccatcagcgttctataaagcggc

SEQ ID NO: 44201 - DNA, 24 bp, Homo sapiens
ccctgcccccggctgctccaactg

SEQ ID NO: 44202 - DNA, 24 bp, Homo sapiens
ggcaccacaccttctacaatgagc

SEQ ID NO: 44203 - DNA, 24 bp, Homo sapiens
cgtaggtgatgaagcccagagcaa

SEQ ID NO: 44204 - DNA, 24 bp, Homo sapiens
tgagaccttcaatgtccctgccat

SEQ ID NO: 44205 - DNA, 24 bp, Homo sapiens
ggcaccacaccttctacaatgagc

SEQ ID NO: 44206 - DNA, 24 bp, Homo sapiens
cgtaggtgatgaagcccagagcaa

SEQ ID NO: 44207 - DNA, 24 bp, Homo sapiens
gccaagatgtgtgacgacgaggag

SEQ ID NO: 44208 - DNA, 24 bp, Homo sapiens
agatcgtctctgccagtgtcctgc

SEQ ID NO: 44209 - DNA, 24 bp, Homo sapiens
gaccctctcaggacatcaagccct

SEQ ID NO: 44210 - DNA, 24 bp, Homo sapiens
gccgccgacgctcagcagttatga

SEQ ID NO: 44211 - DNA, 24 bp, Homo sapiens
ttttgagagcagtataagaaaagc

SEQ ID NO: 44212 - DNA, 24 bp, Homo sapiens
tttttgagagcagtataagaaaag

SEQ ID NO: 44213 - DNA, 24 bp, Homo sapiens
ctttttgagagcagtataagaaaa

SEQ ID NO: 44214 - DNA, 24 bp, Homo sapiens
aagtttggaggagaaggttcatcg

SEQ ID NO: 44215 - DNA, 24 bp, Homo sapiens
caagtttggaggagaaggttcatc

SEQ ID NO: 44216 - DNA, 24 bp, Homo sapiens
ccaagtttggaggagaaggttcat

SEQ ID NO: 44217 - DNA, 24 bp, Homo sapiens
gcctgaaggttgtatatgactgga

SEQ ID NO: 44218 - DNA, 24 bp, Homo sapiens
cgctacaacggcaaccctgatgat

SEQ ID NO: 44219 - DNA, 24 bp, Homo sapiens
gaccgctgtccgtcctgtgccaag

SEQ ID NO: 44220 - DNA, 24 bp, Homo sapiens
atgtgtatcaaggtacagctacgt

SEQ ID NO: 44221 - DNA, 24 bp, Homo sapiens
tttgttatccccttactgagcggc

SEQ ID NO: 44222 - DNA, 24 bp, Homo sapiens
taggtggctgtgattaaatgtccc

SEQ ID NO: 44223 - DNA, 24 bp, Homo sapiens
ggtgctctgagtgaagccatgtcc

SEQ ID NO: 44224 - DNA, 24 bp, Homo sapiens
gggtgctctgagtgaagccatgtc

SEQ ID NO: 44225 - DNA, 24 bp, Homo sapiens
ggggtgctctgagtgaagccatgt

SEQ ID NO: 44226 - DNA, 24 bp, Homo sapiens
tgtagcagccagtcccgtttcatt

SEQ ID NO: 44227 - DNA, 24 bp, Homo sapiens
tgaccactctgtcttgtgtttcca

SEQ ID NO: 44228 - DNA, 24 bp, Homo sapiens
caagtcagtccaggatgctaacat

SEQ ID NO: 44229 - DNA, 24 bp, Homo sapiens
aaagcaaatagtgacaaatgagat

SEQ ID NO: 44230 - DNA, 24 bp, Homo sapiens
taaagcaaatagtgacaaatgaga

SEQ ID NO: 44231 - DNA, 24 bp, Homo sapiens
ctaaagcaaatagtgacaaatgag

SEQ ID NO: 44232 - DNA, 24 bp, Homo sapiens
ccacagcacaggctccaggccaca

SEQ ID NO: 44233 - DNA, 24 bp, Homo sapiens
gccacagcacaggctccaggccac

SEQ ID NO: 44234 - DNA, 24 bp, Homo sapiens
ggccacagcacaggctccaggcca

SEQ ID NO: 44235 - DNA, 24 bp, Homo sapiens
ggaaatttgagtcttcacctgaac

SEQ ID NO: 44236 - DNA, 24 bp, Homo sapiens
cggaaatttgagtcttcacctgaa

SEQ ID NO: 44237 - DNA, 24 bp, Homo sapiens
ccggaaatttgagtcttcacctga

SEQ ID NO: 44238 - DNA, 24 bp, Homo sapiens
tcaggacagcggcttggtcagttc

SEQ ID NO: 44239 - DNA, 24 bp, Homo sapiens
cgggatgggaccttgaaagtgtgg

SEQ ID NO: 44240 - DNA, 24 bp, Homo sapiens
ctcactcaggacccattagccact

SEQ ID NO: 44241 - DNA, 24 bp, Homo sapiens
ctgccgccaccgtcaccgccaccg

SEQ ID NO: 44242 - DNA, 24 bp, Homo sapiens
ttcggcggatcttccattctcagg

SEQ ID NO: 44243 - DNA, 24 bp, Homo sapiens
ccctggggaccctgccatgtgagg

SEQ ID NO: 44244 - DNA, 22 bp, Homo sapiens
aaaaaaaaagagttaacactgc

SEQ ID NO: 44245 - DNA, 24 bp, Homo sapiens
acaaaaaaaaaagagttaacactg

SEQ ID NO: 44246 - DNA, 24 bp, Homo sapiens
gacaaaaaaaaaagagttaacact

SEQ ID NO: 44247 - DNA, 24 bp, Homo sapiens
ctccgccgggcagcacctctacag

SEQ ID NO: 44248 - DNA, 24 bp, Homo sapiens
gagtcgccgaatatcagccgccac

SEQ ID NO: 44249 - DNA, 24 bp, Homo sapiens
cgcccacaggcagccagcagcagg

SEQ ID NO: 44250 - DNA, 24 bp, Homo sapiens
atcgtgttagccaggatggtctcg

SEQ ID NO: 44251 - DNA, 24 bp, Homo sapiens
tccctagacactcccattggttac

SEQ ID NO: 44252 - DNA, 24 bp, Homo sapiens
ttagtgtccagcttcctcttccta

SEQ ID NO: 44253 - DNA, 24 bp, Homo sapiens
tgccgccgacccagccgacccacg

SEQ ID NO: 44254 - DNA, 24 bp, Homo sapiens
cctcaactgccactcgtacctgtc

SEQ ID NO: 44255 - DNA, 24 bp, Homo sapiens
tatttccctgctgttgcgcgcgga

SEQ ID NO: 44256 - DNA, 24 bp, Homo sapiens
aagcagcagcagcagcaacacatc

SEQ ID NO: 44257 - DNA, 24 bp, Homo sapiens
gatatggcaatggtagtcagcacg

SEQ ID NO: 44258 - DNA, 24 bp, Homo sapiens
gacaagtcgagcggcaagcactac

SEQ ID NO: 44259 - DNA, 24 bp, Homo sapiens
cagcagcggcagcagcgacttcag

SEQ ID NO: 44260 - DNA, 24 bp, Homo sapiens
cggcgagttgactctttccctatg

SEQ ID NO: 44261 - DNA, 24 bp, Homo sapiens
tgtgcttctaggtggtgatctgcc

SEQ ID NO: 44262 - DNA, 24 bp, Homo sapiens
ttattctacaggtaagagaatacg

SEQ ID NO: 44263 - DNA, 24 bp, Homo sapiens
cttattctacaggtaagagaatac

SEQ ID NO: 44264 - DNA, 24 bp, Homo sapiens
acttattctacaggtaagagaata

SEQ ID NO: 44265 - DNA, 24 bp, Homo sapiens
ccttagaccaggcaacatttcatt

SEQ ID NO: 44266 - DNA, 24 bp, Homo sapiens
tccttagaccaggcaacatttcat

SEQ ID NO: 44267 - DNA, 24 bp, Homo sapiens
ttccttagaccaggcaacatttca

SEQ ID NO: 44268 - DNA, 24 bp, Homo sapiens
cctgccatgtcgtcatcttcttca

SEQ ID NO: 44269 - DNA, 24 bp, Homo sapiens
aggagcaggagaggcgtgagcgtc

SEQ ID NO: 44270 - DNA, 24 bp, Homo sapiens
catctctgtggttggcgtctctgc

SEQ ID NO: 44271 - DNA, 24 bp, Homo sapiens
cagcatcccagcccagcccatcag

SEQ ID NO: 44272 - DNA, 24 bp, Homo sapiens
cctacacacctggcttcccttcct

SEQ ID NO: 44273 - DNA, 24 bp, Homo sapiens
aagccaagcctgtccagccagcag

SEQ ID NO: 44274 - DNA, 24 bp, Homo sapiens
cagtgggccgcctgctgctggtgc

SEQ ID NO: 44275 - DNA, 24 bp, Homo sapiens
tgcaggacctgcgggccaggggcg

SEQ ID NO: 44276 - DNA, 24 bp, Homo sapiens
tttcttgattggatttatgattgg

SEQ ID NO: 44277 - DNA, 24 bp, Homo sapiens
ttttcttgattggatttatgattg

SEQ ID NO: 44278 - DNA, 24 bp, Homo sapiens
tttttcttgattggatttatgatt

SEQ ID NO: 44279 - DNA, 24 bp, Homo sapiens
tttcttgattggaagcaaatgcta

SEQ ID NO: 44280 - DNA, 24 bp, Homo sapiens
ttttcttgattggaagcaaatgct

SEQ ID NO: 44281 - DNA, 24 bp, Homo sapiens
tttttcttgattggaagcaaatgc

SEQ ID NO: 44282 - DNA, 24 bp, Homo sapiens
cgctgggactgggcactgctggtg

SEQ ID NO: 44283 - DNA, 24 bp, Homo sapiens
acgctgggactgggcactgctggt

SEQ ID NO: 44284 - DNA, 24 bp, Homo sapiens
cacgctgggactgggcactgctgg

SEQ ID NO: 44285 - DNA, 24 bp, Homo sapiens
cagtgcccagtgcccaagcctctg

SEQ ID NO: 44286 - DNA, 24 bp, Homo sapiens
gcagtgcccagtgcccaagcctct

SEQ ID NO: 44287 - DNA, 24 bp, Homo sapiens
agcagtgcccagtgcccaagcctc

SEQ ID NO: 44288 - DNA, 24 bp, Homo sapiens
gactaccacctcgcacatgccaag

SEQ ID NO: 44289 - DNA, 24 bp, Homo sapiens
tccattctcctcttccagcggtgt

SEQ ID NO: 44290 - DNA, 24 bp, Homo sapiens
tgccactcagttcaacatcacaga

SEQ ID NO: 44291 - DNA, 24 bp, Homo sapiens
cttctgccacctcagccactctgg

SEQ ID NO: 44292 - DNA, 24 bp, Homo sapiens
ctgggcaagtggtgacggctctgg

SEQ ID NO: 44293 - DNA, 24 bp, Homo sapiens
cacttcgtttgcggaggctgttcc

SEQ ID NO: 44294 - DNA, 24 bp, Homo sapiens
gttctagcagcagcagcaaacaga

SEQ ID NO: 44295 - DNA, 24 bp, Homo sapiens
gggatgtgctaagcaaaggcaaca

SEQ ID NO: 44296 - DNA, 24 bp, Homo sapiens
caggccctcaagtggaaataagct

SEQ ID NO: 44297 - DNA, 24 bp, Homo sapiens
caaggtcgaggagctgcatctggt

SEQ ID NO: 44298 - DNA, 24 bp, Homo sapiens
cttcctagcgaggactccctgagg

SEQ ID NO: 44299 - DNA, 24 bp, Homo sapiens
aatttctccaccaattttccatgg

SEQ ID NO: 44300 - DNA, 24 bp, Homo sapiens
caatttctccaccaattttccatg

SEQ ID NO: 44301 - DNA, 24 bp, Homo sapiens
ccaatttctccaccaattttccat

SEQ ID NO: 44302 - DNA, 24 bp, Homo sapiens
tttttgctgaggtgaatagtgaca

SEQ ID NO: 44303 - DNA, 24 bp, Homo sapiens
atttttgctgaggtgaatagtgac

SEQ ID NO: 44304 - DNA, 24 bp, Homo sapiens
catttttgctgaggtgaatagtga

SEQ ID NO: 44305 - DNA, 24 bp, Homo sapiens
ctaccacgccatctccagagccag

SEQ ID NO: 44306 - DNA, 24 bp, Homo sapiens
ctcgctgctgtggctgctgttcat

SEQ ID NO: 44307 - DNA, 24 bp, Homo sapiens
ctctggcactcgaagacctggctc

SEQ ID NO: 44308 - DNA, 24 bp, Homo sapiens
agagatgctgtggaggagggtgac

SEQ ID NO: 44309 - DNA, 23 bp, Homo sapiens
gcctgtatcgcctcagcctggag

SEQ ID NO: 44310 - DNA, 23 bp, Homo sapiens
cggaagaggagcggcaggagtat

SEQ ID NO: 44311 - DNA, 24 bp, Homo sapiens
ccaatttccagctctaggagtcca

SEQ ID NO: 44312 - DNA, 24 bp, Homo sapiens
gccaatttccagctctaggagtcc

SEQ ID NO: 44313 - DNA, 24 bp, Homo sapiens
tgccaatttccagctctaggagtc

SEQ ID NO: 44314 - DNA, 24 bp, Homo sapiens
acacagacaagttctccagccagg

SEQ ID NO: 44315 - DNA, 24 bp, Homo sapiens
ccttggctctaacgaaagactgga

SEQ ID NO: 44316 - DNA, 24 bp, Homo sapiens
agtagtggtggctggagtgcggtg

SEQ ID NO: 44317 - DNA, 24 bp, Homo sapiens
agtagtggtggctggagtgcggtg

SEQ ID NO: 44318 - DNA, 24 bp, Homo sapiens
ggcggcatctcctctgtgaaactt

SEQ ID NO: 44319 - DNA, 24 bp, Homo sapiens
aagagtatgttcaggaagatgccg

SEQ ID NO: 44320 - DNA, 24 bp, Homo sapiens
gccttggctctaacgaaagactgg

SEQ ID NO: 44321 - DNA, 24 bp, Homo sapiens
acacagacaagttctccagccagg

SEQ ID NO: 44322 - DNA, 24 bp, Homo sapiens
tgagaagaggcagaggaaggcgaa

SEQ ID NO: 44323 - DNA, 23 bp, Homo sapiens
ctccctgctgccaggctcccact

SEQ ID NO: 44324 - DNA, 23 bp, Homo sapiens
cacctgcttctcagcgcaacagc

SEQ ID NO: 44325 - DNA, 23 bp, Homo sapiens
gaggttgtgctgcctgtggtgag

SEQ ID NO: 44326 - DNA, 24 bp, Homo sapiens
caacgatggcaacaatggtggctg

SEQ ID NO: 44327 - DNA, 24 bp, Homo sapiens
acaggtgtctggtgtgggcattga

SEQ ID NO: 44328 - DNA, 24 bp, Homo sapiens
agtgtacgagtacccaggctaccg

SEQ ID NO: 44329 - DNA, 24 bp, Homo sapiens
ctttctcacaggaataaaaaacat

SEQ ID NO: 44330 - DNA, 24 bp, Homo sapiens
tctttctcacaggaataaaaaaca

SEQ ID NO: 44331 - DNA, 24 bp, Homo sapiens
ttctttctcacaggaataaaaaac

SEQ ID NO: 44332 - DNA, 24 bp, Homo sapiens
tggtgaagtgggtttacttgaact

SEQ ID NO: 44333 - DNA, 24 bp, Homo sapiens
ctggtgaagtgggtttacttgaac

SEQ ID NO: 44334 - DNA, 24 bp, Homo sapiens
tctggtgaagtgggtttacttgaa

SEQ ID NO: 44335 - DNA, 24 bp, Homo sapiens
ctcccgccgccctggtgccttagc

SEQ ID NO: 44336 - DNA, 24 bp, Homo sapiens
gctgtcttgcctcttgtcattgtc

SEQ ID NO: 44337 - DNA, 24 bp, Homo sapiens
caaggcatctggagggctttcgtg

SEQ ID NO: 44338 - DNA, 24 bp, Homo sapiens
gagacctacttccatgagtttggc

SEQ ID NO: 44339 - DNA, 24 bp, Homo sapiens
caggatgggagccgccagatcgcc

SEQ ID NO: 44340 - DNA, 24 bp, Homo sapiens
ctgctttggcctgcagcccggctg

SEQ ID NO: 44341 - DNA, 24 bp, Homo sapiens
gtggctgctgctgctcctgctctc

SEQ ID NO: 44342 - DNA, 24 bp, Homo sapiens
cctcatcaggagttccagtgctgc

SEQ ID NO: 44343 - DNA, 24 bp, Homo sapiens
tctccgcacacctctggctgtctt

SEQ ID NO: 44344 - DNA, 24 bp, Homo sapiens
ttgactcttccctctgtggtgtga

SEQ ID NO: 44345 - DNA, 24 bp, Homo sapiens
ccactcggcacttgtgattcgggc

SEQ ID NO: 44346 - DNA, 24 bp, Homo sapiens
ctgttgctgcggctgctggcgttg

SEQ ID NO: 44347 - DNA, 24 bp, Homo sapiens
tgtctcaggaacatcaacaacagg

SEQ ID NO: 44348 - DNA, 24 bp, Homo sapiens
ctgtctcaggaacatcaacaacag

SEQ ID NO: 44349 - DNA, 24 bp, Homo sapiens
tctgtctcaggaacatcaacaaca

SEQ ID NO: 44350 - DNA, 24 bp, Homo sapiens
cctcctcggcaagttccacttctt

SEQ ID NO: 44351 - DNA, 24 bp, Homo sapiens
atcgcctgctaaagaaggatgctt

SEQ ID NO: 44352 - DNA, 24 bp, Homo sapiens
gcaagccctgcccactcgccccgg

SEQ ID NO: 44353 - DNA, 24 bp, Homo sapiens
gccgcctccatatcatcaagctct

SEQ ID NO: 44354 - DNA, 24 bp, Homo sapiens
ggcttttcggatcggcaggatgta

SEQ ID NO: 44355 - DNA, 24 bp, Homo sapiens
caccaccccacttcagcctccccc

SEQ ID NO: 44356 - DNA, 24 bp, Homo sapiens
catcttgttagaatgaaaaatcta

SEQ ID NO: 44357 - DNA, 24 bp, Homo sapiens
tcatcttgttagaatgaaaaatct

SEQ ID NO: 44358 - DNA, 24 bp, Homo sapiens
ttcatcttgttagaatgaaaaatc

SEQ ID NO: 44359 - DNA, 24 bp, Homo sapiens
tattctttaaggtggacttggaga

SEQ ID NO: 44360 - DNA, 24 bp, Homo sapiens
ttattctttaaggtggacttggag

SEQ ID NO: 44361 - DNA, 24 bp, Homo sapiens
tttattctttaaggtggacttgga

SEQ ID NO: 44362 - DNA, 24 bp, Homo sapiens
ggattcatcttctcggagctgcgg

SEQ ID NO: 44363 - DNA, 24 bp, Homo sapiens
tttgggctcaggcggcggcggctc

SEQ ID NO: 44364 - DNA, 24 bp, Homo sapiens
gcggagtcctggcagcagcgggga

SEQ ID NO: 44365 - DNA, 24 bp, Homo sapiens
gtggctctgggccattagaagaaa

SEQ ID NO: 44366 - DNA, 24 bp, Homo sapiens
tgtggctctgggccattagaagaa

SEQ ID NO: 44367 - DNA, 24 bp, Homo sapiens
ctgtggctctgggccattagaaga

SEQ ID NO: 44368 - DNA, 24 bp, Homo sapiens
cactgcgtctggaggatctcggtc

SEQ ID NO: 44369 - DNA, 24 bp, Homo sapiens
gccgactgtgctggtatgattacg

SEQ ID NO: 44370 - DNA, 24 bp, Homo sapiens
gttccgcagcagcagcaacatctt

SEQ ID NO: 44371 - DNA, 24 bp, Homo sapiens
cttttctacagcagaatcatgaga

SEQ ID NO: 44372 - DNA, 24 bp, Homo sapiens
tcttttctacagcagaatcatgag

SEQ ID NO: 44373 - DNA, 24 bp, Homo sapiens
ttcttttctacagcagaatcatga

SEQ ID NO: 44374 - DNA, 24 bp, Homo sapiens
ggagaaattggaattcttcgattt

SEQ ID NO: 44375 - DNA, 24 bp, Homo sapiens
tggagaaattggaattcttcgatt

SEQ ID NO: 44376 - DNA, 24 bp, Homo sapiens
atggagaaattggaattcttcgat

SEQ ID NO: 44377 - DNA, 24 bp, Homo sapiens
agtgacacaatctcggctgactgc

SEQ ID NO: 44378 - DNA, 24 bp, Homo sapiens
gagtctcactctgccgcccaggct

SEQ ID NO: 44379 - DNA, 24 bp, Homo sapiens
ttttgcgtccgggaggagccaacc

SEQ ID NO: 44380 - DNA, 24 bp, Homo sapiens
gctcatcggaactggcaccactat

SEQ ID NO: 44381 - DNA, 24 bp, Homo sapiens
tcccttattgccgagaactccaca

SEQ ID NO: 44382 - DNA, 24 bp, Homo sapiens
atcctgctggctgttggagtctgg

SEQ ID NO: 44383 - DNA, 24 bp, Homo sapiens
gatatttaaatgtgtgagttaata

SEQ ID NO: 44384 - DNA, 24 bp, Homo sapiens
cgatatttaaatgtgtgagttaat

SEQ ID NO: 44385 - DNA, 24 bp, Homo sapiens
gcgatatttaaatgtgtgagttaa

SEQ ID NO: 44386 - DNA, 24 bp, Homo sapiens
ttgttctctagatactgggtttgg

SEQ ID NO: 44387 - DNA, 24 bp, Homo sapiens
tttgttctctagatactgggtttg

SEQ ID NO: 44388 - DNA, 24 bp, Homo sapiens
ttttgttctctagatactgggttt

SEQ ID NO: 44389 - DNA, 24 bp, Homo sapiens
gattgctgtaggtgccatcatcat

SEQ ID NO: 44390 - DNA, 24 bp, Homo sapiens
cctgggatgctgcggtgctataaa

SEQ ID NO: 44391 - DNA, 24 bp, Homo sapiens
ggcttgcttctgatcctgctcctg

SEQ ID NO: 44392 - DNA, 23 bp, Homo sapiens
ttcttcctgctgctgctgctggt

SEQ ID NO: 44393 - DNA, 25 bp, Homo sapiens
ggtgccatcaaggagaacaagtgcc

SEQ ID NO: 44394 - DNA, 24 bp, Homo sapiens
gctgccaacttgctcatcatcacc

SEQ ID NO: 44395 - DNA, 24 bp, Homo sapiens
agctcttagaattaaagtccttgg

SEQ ID NO: 44396 - DNA, 24 bp, Homo sapiens
aagctcttagaattaaagtccttg

SEQ ID NO: 44397 - DNA, 24 bp, Homo sapiens
gaagctcttagaattaaagtcctt

SEQ ID NO: 44398 - DNA, 24 bp, Homo sapiens
caatgaagaagactctaaaataga

SEQ ID NO: 44399 - DNA, 24 bp, Homo sapiens
acaatgaagaagactctaaaatag

SEQ ID NO: 44400 - DNA, 24 bp, Homo sapiens
gacaatgaagaagactctaaaata

SEQ ID NO: 44401 - DNA, 24 bp, Homo sapiens
gttatttccagactctaaaataga

SEQ ID NO: 44402 - DNA, 24 bp, Homo sapiens
tgttatttccagactctaaaatag

SEQ ID NO: 44403 - DNA, 24 bp, Homo sapiens
atgttatttccagactctaaaata

SEQ ID NO: 44404 - DNA, 24 bp, Homo sapiens
tctggtcacagcgattgaacagga

SEQ ID NO: 44405 - DNA, 24 bp, Homo sapiens
ttctggtcacagcgattgaacagg

SEQ ID NO: 44406 - DNA, 24 bp, Homo sapiens
tttctggtcacagcgattgaacag

SEQ ID NO: 44407 - DNA, 24 bp, Homo sapiens
ctgcagctgtggcggcgcggcgtg

SEQ ID NO: 44408 - DNA, 24 bp, Homo sapiens
ctcggggctggcggccacgcgccc

SEQ ID NO: 44409 - DNA, 24 bp, Homo sapiens
cagggaaggatgggtacgacggac

SEQ ID NO: 44410 - DNA, 24 bp, Homo sapiens
gccaacacaggctgctacgggatc

SEQ ID NO: 44411 - DNA, 24 bp, Homo sapiens
ctgctgctgctcctgctgctgctg

SEQ ID NO: 44412 - DNA, 24 bp, Homo sapiens
agaaatatgacatcaccacgctca

SEQ ID NO: 44413 - DNA, 24 bp, Homo sapiens
cagaaatatgacatcaccacgctc

SEQ ID NO: 44414 - DNA, 24 bp, Homo sapiens
ccagaaatatgacatcaccacgct

SEQ ID NO: 44415 - DNA, 24 bp, Homo sapiens
gcccagaagcacagcaagaaggct

SEQ ID NO: 44416 - DNA, 24 bp, Homo sapiens
ggcccagaagcacagcaagaaggc

SEQ ID NO: 44417 - DNA, 24 bp, Homo sapiens
aggcccagaagcacagcaagaagg

SEQ ID NO: 44418 - DNA, 24 bp, Homo sapiens
aattcgtggcagcagcagcagcag

SEQ ID NO: 44419 - DNA, 24 bp, Homo sapiens
ggagcctatggtcaatggaggagg

SEQ ID NO: 44420 - DNA, 24 bp, Homo sapiens
ttggagagtcttgtagccagcagg

SEQ ID NO: 44421 - DNA, 24 bp, Homo sapiens
cagcagtttgacctggagccttct

SEQ ID NO: 44422 - DNA, 24 bp, Homo sapiens
cccaacaactttgaaacaaccact

SEQ ID NO: 44423 - DNA, 24 bp, Homo sapiens
ggtgacttcccctctgttccccaa

SEQ ID NO: 44424 - DNA, 24 bp, Homo sapiens
atattacaaaggtttgtaatgaaa

SEQ ID NO: 44425 - DNA, 24 bp, Homo sapiens
aatattacaaaggtttgtaatgaa

SEQ ID NO: 44426 - DNA, 24 bp, Homo sapiens
aaatattacaaaggtttgtaatga

SEQ ID NO: 44427 - DNA, 24 bp, Homo sapiens
gaaatgaaaaagtgagttgatagt

SEQ ID NO: 44428 - DNA, 24 bp, Homo sapiens
agaaatgaaaaagtgagttgatag

SEQ ID NO: 44429 - DNA, 24 bp, Homo sapiens
aagaaatgaaaaagtgagttgata

SEQ ID NO: 44430 - DNA, 24 bp, Homo sapiens
tgttcaaacagacatggatggata

SEQ ID NO: 44431 - DNA, 24 bp, Homo sapiens
atgttcaaacagacatggatggat

SEQ ID NO: 44432 - DNA, 24 bp, Homo sapiens
aatgttcaaacagacatggatgga

SEQ ID NO: 44433 - DNA, 24 bp, Homo sapiens
ttctattgcaggtgaaaaatcaca

SEQ ID NO: 44434 - DNA, 24 bp, Homo sapiens
cttctattgcaggtgaaaaatcac

SEQ ID NO: 44435 - DNA, 24 bp, Homo sapiens
acttctattgcaggtgaaaaatca

SEQ ID NO: 44436 - DNA, 24 bp, Homo sapiens
tttttaaagcagtgagtaaaactt

SEQ ID NO: 44437 - DNA, 24 bp, Homo sapiens
ttttttaaagcagtgagtaaaact

SEQ ID NO: 44438 - DNA, 24 bp, Homo sapiens
attttttaaagcagtgagtaaaac

SEQ ID NO: 44439 - DNA, 24 bp, Homo sapiens
gccatctacaagcagtcacagcac

SEQ ID NO: 44440 - DNA, 24 bp, Homo sapiens
ctcctcagcatcttatccgagtgg

SEQ ID NO: 44441 - DNA, 24 bp, Homo sapiens
tagtgtggtggtgccctatgagcc

SEQ ID NO: 44442 - DNA, 24 bp, Homo sapiens
ctctgcctcctggtaaaaggacaa

SEQ ID NO: 44443 - DNA, 24 bp, Homo sapiens
tctctgcctcctggtaaaaggaca

SEQ ID NO: 44444 - DNA, 24 bp, Homo sapiens
ctctctgcctcctggtaaaaggac

SEQ ID NO: 44445 - DNA, 24 bp, Homo sapiens
gtcctctcgcccatgaacaaggtg

SEQ ID NO: 44446 - DNA, 24 bp, Homo sapiens
gactcctatcggcagcagcagcag

SEQ ID NO: 44447 - DNA, 24 bp, Homo sapiens
gtgaagaagcggcggcatggagac

SEQ ID NO: 44448 - DNA, 24 bp, Homo sapiens
ttaattatcagggcttcaaagaca

SEQ ID NO: 44449 - DNA, 24 bp, Homo sapiens
tttaattatcagggcttcaaagac

SEQ ID NO: 44450 - DNA, 24 bp, Homo sapiens
ctttaattatcagggcttcaaaga

SEQ ID NO: 44451 - DNA, 24 bp, Homo sapiens
tctcaccacagagaaagtggctca

SEQ ID NO: 44452 - DNA, 24 bp, Homo sapiens
atctcaccacagagaaagtggctc

SEQ ID NO: 44453 - DNA, 24 bp, Homo sapiens
aatctcaccacagagaaagtggct

SEQ ID NO: 44454 - DNA, 23 bp, Homo sapiens
gaggagctgcacaaggcggagga

SEQ ID NO: 44455 - DNA, 23 bp, Homo sapiens
aaggagaagttgctgcgggtgtc

SEQ ID NO: 44456 - DNA, 23 bp, Homo sapiens
gacaagaaggcggcggaagacag

SEQ ID NO: 44457 - DNA, 24 bp, Homo sapiens
gccgccacgagactttcacatcaa

SEQ ID NO: 44458 - DNA, 24 bp, Homo sapiens
gctgggaaatcctcagggctccta

SEQ ID NO: 44459 - DNA, 24 bp, Homo sapiens
ttccttccctggttgacttgactc

SEQ ID NO: 44460 - DNA, 24 bp, Homo sapiens
gctgggaaatcctcagggctccta

SEQ ID NO: 44461 - DNA, 24 bp, Homo sapiens
gactgcctcgctgccccacctccc

SEQ ID NO: 44462 - DNA, 24 bp, Homo sapiens
ttccttccctggttgacttgactc

SEQ ID NO: 44463 - DNA, 25 bp, Homo sapiens
tgaagaggtggctcgtaagttggtg

SEQ ID NO: 44464 - DNA, 23 bp, Homo sapiens
ttggaacgcacagaggaacgagc

SEQ ID NO: 44465 - DNA, 23 bp, Homo sapiens
ccgttgccgagagatggatgagc

SEQ ID NO: 44466 - DNA, 23 bp, Homo sapiens
gttgaagaagagctggaccgtgc

SEQ ID NO: 44467 - DNA, 23 bp, Homo sapiens
ggaacaggctgaggctgaggtgg

SEQ ID NO: 44468 - DNA, 25 bp, Homo sapiens
cagcgagaagttgagggagaaaggc

SEQ ID NO: 44469 - DNA, 24 bp, Homo sapiens
gacggtgactggttttggtgggag

SEQ ID NO: 44470 - DNA, 24 bp, Homo sapiens
ggacggtgactggttttggtggga

SEQ ID NO: 44471 - DNA, 24 bp, Homo sapiens
gggacggtgactggttttggtggg

SEQ ID NO: 44472 - DNA, 24 bp, Homo sapiens
tgcaacaacagaaaaatgaaatat

SEQ ID NO: 44473 - DNA, 24 bp, Homo sapiens
ttgcaacaacagaaaaatgaaata

SEQ ID NO: 44474 - DNA, 24 bp, Homo sapiens
cttgcaacaacagaaaaatgaaat

SEQ ID NO: 44475 - DNA, 23 bp, Homo sapiens
ccgctggtgaggaggctggacgc

SEQ ID NO: 44476 - DNA, 23 bp, Homo sapiens
cgtgttctccacagccgccttcc

SEQ ID NO: 44477 - DNA, 24 bp, Homo sapiens
ctatgaaggctatgactccaccgc

SEQ ID NO: 44478 - DNA, 24 bp, Homo sapiens
actataaaaaagtacctaaccagt

SEQ ID NO: 44479 - DNA, 24 bp, Homo sapiens
tactataaaaaagtacctaaccag

SEQ ID NO: 44480 - DNA, 24 bp, Homo sapiens
ctactataaaaaagtacctaacca

SEQ ID NO: 44481 - DNA, 24 bp, Homo sapiens
ttcgattcctcgtaagtgctttat

SEQ ID NO: 44482 - DNA, 24 bp, Homo sapiens
attcgattcctcgtaagtgcttta

SEQ ID NO: 44483 - DNA, 24 bp, Homo sapiens
tattcgattcctcgtaagtgcttt

SEQ ID NO: 44484 - DNA, 24 bp, Homo sapiens
caaggaagtaaatgagtggatggc

SEQ ID NO: 44485 - DNA, 23 bp, Homo sapiens
tcttgaaaacatcgtagcgattc

SEQ ID NO: 44486 - DNA, 23 bp, Homo sapiens
tgtgccttccttattgcctctga

SEQ ID NO: 44487 - DNA, 25 bp, Homo sapiens
aggaggcacagatagaacaggaact

SEQ ID NO: 44488 - DNA, 25 bp, Homo sapiens
acgatcctaagcacttccataatag

SEQ ID NO: 44489 - DNA, 24 bp, Homo sapiens
gcgtgggctcgctggtggtaaaaa

SEQ ID NO: 44490 - DNA, 24 bp, Homo sapiens
tgcgtgggctcgctggtggtaaaa

SEQ ID NO: 44491 - DNA, 24 bp, Homo sapiens
ctgcgtgggctcgctggtggtaaa

SEQ ID NO: 44492 - DNA, 24 bp, Homo sapiens
ttacaacctggaggaaagctgtac

SEQ ID NO: 44493 - DNA, 24 bp, Homo sapiens
attacaacctggaggaaagctgta

SEQ ID NO: 44494 - DNA, 24 bp, Homo sapiens
tattacaacctggaggaaagctgt

SEQ ID NO: 44495 - DNA, 24 bp, Homo sapiens
actccttgtcttctcagaaccagc

SEQ ID NO: 44496 - DNA, 24 bp, Homo sapiens
ggatcttcaccgtcaaccacaagc

SEQ ID NO: 44497 - DNA, 24 bp, Homo sapiens
caagtggtggagaaggtggtgctg

SEQ ID NO: 44498 - DNA, 24 bp, Homo sapiens
gccagtggaagatccgagcctact

SEQ ID NO: 44499 - DNA, 24 bp, Homo sapiens
ggatcttcaccgtcaaccacaagc

SEQ ID NO: 44500 - DNA, 24 bp, Homo sapiens
caagtggtggagaaggtggtgctg

SEQ ID NO: 44501 - DNA, 24 bp, Homo sapiens
gctctacccagaccaaggaaaatg

SEQ ID NO: 44502 - DNA, 24 bp, Homo sapiens
ggctctacccagaccaaggaaaat

SEQ ID NO: 44503 - DNA, 24 bp, Homo sapiens
tggctctacccagaccaaggaaaa

SEQ ID NO: 44504 - DNA, 24 bp, Homo sapiens
tcttcaacaagataaaatgtcaac

SEQ ID NO: 44505 - DNA, 24 bp, Homo sapiens
gtcttcaacaagataaaatgtcaa

SEQ ID NO: 44506 - DNA, 24 bp, Homo sapiens
agtcttcaacaagataaaatgtca

SEQ ID NO: 44507 - DNA, 24 bp, Homo sapiens
gaaagtacaaggtcaacaggactg

SEQ ID NO: 44508 - DNA, 24 bp, Homo sapiens
tgaaagtacaaggtcaacaggact

SEQ ID NO: 44509 - DNA, 24 bp, Homo sapiens
gtgaaagtacaaggtcaacaggac

SEQ ID NO: 44510 - DNA, 24 bp, Homo sapiens
cattttcaaaggtaaatatttata

SEQ ID NO: 44511 - DNA, 24 bp, Homo sapiens
tcattttcaaaggtaaatatttat

SEQ ID NO: 44512 - DNA, 24 bp, Homo sapiens
atcattttcaaaggtaaatattta

SEQ ID NO: 44513 - DNA, 24 bp, Homo sapiens
aatctcaggaggtttttaaagaca

SEQ ID NO: 44514 - DNA, 24 bp, Homo sapiens
aaatctcaggaggtttttaaagac

SEQ ID NO: 44515 - DNA, 24 bp, Homo sapiens
caaatctcaggaggtttttaaaga

SEQ ID NO: 44516 - DNA, 24 bp, Homo sapiens
cggaagtactcagtctggatcggg

SEQ ID NO: 44517 - DNA, 24 bp, Homo sapiens
cagcagatgtggatcagcaagcct

SEQ ID NO: 44518 - DNA, 24 bp, Homo sapiens
cctccattgtccacaggaagtgct

SEQ ID NO: 44519 - DNA, 24 bp, Homo sapiens
tccctgtgcagtggaagcaaacga

SEQ ID NO: 44520 - DNA, 24 bp, Homo sapiens
ttccctgtgcagtggaagcaaacg

SEQ ID NO: 44521 - DNA, 24 bp, Homo sapiens
cttccctgtgcagtggaagcaaac

SEQ ID NO: 44522 - DNA, 24 bp, Homo sapiens
gtgtgcatctggcggaacggcaag

SEQ ID NO: 44523 - DNA, 24 bp, Homo sapiens
cgtgtgcatctggcggaacggcaa

SEQ ID NO: 44524 - DNA, 24 bp, Homo sapiens
ccgtgtgcatctggcggaacggca

SEQ ID NO: 44525 - DNA, 24 bp, Homo sapiens
ctcgagggacagtgagtcatctgg

SEQ ID NO: 44526 - DNA, 24 bp, Homo sapiens
cctcgagggacagtgagtcatctg

SEQ ID NO: 44527 - DNA, 24 bp, Homo sapiens
acctcgagggacagtgagtcatct

SEQ ID NO: 44528 - DNA, 24 bp, Homo sapiens
ctctgggggctgatctgggcatcc

SEQ ID NO: 44529 - DNA, 24 bp, Homo sapiens
cctctcttggatcctccagccatg

SEQ ID NO: 44530 - DNA, 24 bp, Homo sapiens
agaaggtagcagacagacagacgg

SEQ ID NO: 44531 - DNA, 24 bp, Homo sapiens
gtcatggtggagaactctcacggc

SEQ ID NO: 44532 - DNA, 24 bp, Homo sapiens
ccagacatctcagagccagggacc

SEQ ID NO: 44533 - DNA, 24 bp, Homo sapiens
tccaacagcagcacccagtttgag

SEQ ID NO: 44534 - DNA, 24 bp, Homo sapiens
tttctctgcagcgaggaggtctgc

SEQ ID NO: 44535 - DNA, 24 bp, Homo sapiens
ctttctctgcagcgaggaggtctg

SEQ ID NO: 44536 - DNA, 24 bp, Homo sapiens
tctttctctgcagcgaggaggtct

SEQ ID NO: 44537 - DNA, 24 bp, Homo sapiens
atccagcagcacagcctcctccag

SEQ ID NO: 44538 - DNA, 24 bp, Homo sapiens
ctgtggagaagaggaaggcgagga

SEQ ID NO: 44539 - DNA, 24 bp, Homo sapiens
tctctccaaatcctcctcctcggg

SEQ ID NO: 44540 - DNA, 24 bp, Homo sapiens
tgacagtggtgatccatgacttca

SEQ ID NO: 44541 - DNA, 24 bp, Homo sapiens
acaagcctgactggtgtctggtgc

SEQ ID NO: 44542 - DNA, 24 bp, Homo sapiens
tggaaatggagggcatcttcaacc

SEQ ID NO: 44543 - DNA, 24 bp, Homo sapiens
ccctggctcagaggtgaaacttcg

SEQ ID NO: 44544 - DNA, 24 bp, Homo sapiens
atgaagagaagcggaaatctgccc

SEQ ID NO: 44545 - DNA, 24 bp, Homo sapiens
tgaccagtggcgtggaagagattc

SEQ ID NO: 44546 - DNA, 24 bp, Homo sapiens
catgctggaagacctcagagttgg

SEQ ID NO: 44547 - DNA, 24 bp, Homo sapiens
gcatgctggaagacctcagagttg

SEQ ID NO: 44548 - DNA, 24 bp, Homo sapiens
agcatgctggaagacctcagagtt

SEQ ID NO: 44549 - DNA, 24 bp, Homo sapiens
acgaagaagctggttcacgacatg

SEQ ID NO: 44550 - DNA, 24 bp, Homo sapiens
ctgagccagcctccagaggatgag

SEQ ID NO: 44551 - DNA, 24 bp, Homo sapiens
gcaggaagaggaagaggaggcgag

SEQ ID NO: 44552 - DNA, 24 bp, Homo sapiens
aagcagccggagcccgccagagcc

SEQ ID NO: 44553 - DNA, 24 bp, Homo sapiens
ggagggcgatcccccgcggcaccc

SEQ ID NO: 44554 - DNA, 24 bp, Homo sapiens
gccatgtcggggcccacctggctg

SEQ ID NO: 44555 - DNA, 25 bp, Homo sapiens
ttctcatcagcactcaggaatcctc

SEQ ID NO: 44556 - DNA, 25 bp, Homo sapiens
tgaacgagcaagctacactctggag

SEQ ID NO: 44557 - DNA, 23 bp, Homo sapiens
ctcaggttgctgctgctgtccag

SEQ ID NO: 44558 - DNA, 24 bp, Homo sapiens
gtagcacacgcagcctccttcacc

SEQ ID NO: 44559 - DNA, 24 bp, Homo sapiens
ctccttcctaatgaaaccagcaca

SEQ ID NO: 44560 - DNA, 24 bp, Homo sapiens
atcattcattgcgagattcatggc

SEQ ID NO: 44561 - DNA, 24 bp, Homo sapiens
tcagaccacaggggcctggatcat

SEQ ID NO: 44562 - DNA, 24 bp, Homo sapiens
ctcagaccacaggggcctggatca

SEQ ID NO: 44563 - DNA, 24 bp, Homo sapiens
gctcagaccacaggggcctggatc

SEQ ID NO: 44564 - DNA, 24 bp, Homo sapiens
gctttttctaggtgtggccatcaa

SEQ ID NO: 44565 - DNA, 24 bp, Homo sapiens
tgctttttctaggtgtggccatca

SEQ ID NO: 44566 - DNA, 24 bp, Homo sapiens
gtgctttttctaggtgtggccatc

SEQ ID NO: 44567 - DNA, 24 bp, Homo sapiens
tgattttacaaatatggtccggaa

SEQ ID NO: 44568 - DNA, 24 bp, Homo sapiens
atgattttacaaatatggtccgga

SEQ ID NO: 44569 - DNA, 24 bp, Homo sapiens
tatgattttacaaatatggtccgg

SEQ ID NO: 44570 - DNA, 24 bp, Homo sapiens
tcattggcgtcacagtctaagcga

SEQ ID NO: 44571 - DNA, 24 bp, Homo sapiens
aaaccgccagagggaagggattgt

SEQ ID NO: 44572 - DNA, 24 bp, Homo sapiens
cgcctcatgcctgtaattccagca

SEQ ID NO: 44573 - DNA, 24 bp, Homo sapiens
aacccctccaagtttaatcagtac

SEQ ID NO: 44574 - DNA, 24 bp, Homo sapiens
caacccctccaagtttaatcagta

SEQ ID NO: 44575 - DNA, 24 bp, Homo sapiens
ccaacccctccaagtttaatcagt

SEQ ID NO: 44576 - DNA, 24 bp, Homo sapiens
ggattcatatggtaatacatacaa

SEQ ID NO: 44577 - DNA, 24 bp, Homo sapiens
tggattcatatggtaatacataca

SEQ ID NO: 44578 - DNA, 24 bp, Homo sapiens
ttggattcatatggtaatacatac

SEQ ID NO: 44579 - DNA, 24 bp, Homo sapiens
gtgactcacattggcattttcaac

SEQ ID NO: 44580 - DNA, 24 bp, Homo sapiens
agtgactcacattggcattttcaa

SEQ ID NO: 44581 - DNA, 24 bp, Homo sapiens
aagtgactcacattggcattttca

SEQ ID NO: 44582 - DNA, 24 bp, Homo sapiens
acagggcttctcattccactccaa

SEQ ID NO: 44583 - DNA, 24 bp, Homo sapiens
gcagacaccacaacagcagcctta

SEQ ID NO: 44584 - DNA, 24 bp, Homo sapiens
ttctctgaccacaacttcgcagga

SEQ ID NO: 44585 - DNA, 24 bp, Homo sapiens
catggttcatcaggtgctctaccg

SEQ ID NO: 44586 - DNA, 24 bp, Homo sapiens
caagtggctggcggagtccatcag

SEQ ID NO: 44587 - DNA, 24 bp, Homo sapiens
gccctacgagatgatgctgcccag

SEQ ID NO: 44588 - DNA, 24 bp, Homo sapiens
cagactttaaggtaaataatgagt

SEQ ID NO: 44589 - DNA, 24 bp, Homo sapiens
ccagactttaaggtaaataatgag

SEQ ID NO: 44590 - DNA, 24 bp, Homo sapiens
tccagactttaaggtaaataatga

SEQ ID NO: 44591 - DNA, 24 bp, Homo sapiens
attgaatatagacctgaaaactac

SEQ ID NO: 44592 - DNA, 24 bp, Homo sapiens
cattgaatatagacctgaaaacta

SEQ ID NO: 44593 - DNA, 24 bp, Homo sapiens
ccattgaatatagacctgaaaact

SEQ ID NO: 44594 - DNA, 24 bp, Homo sapiens
gaggactccaggtttattgatcat

SEQ ID NO: 44595 - DNA, 24 bp, Homo sapiens
tgaggactccaggtttattgatca

SEQ ID NO: 44596 - DNA, 24 bp, Homo sapiens
atgaggactccaggtttattgatc

SEQ ID NO: 44597 - DNA, 24 bp, Homo sapiens
ctgggatgcagttctgtgttaaaa

SEQ ID NO: 44598 - DNA, 24 bp, Homo sapiens
tctgggatgcagttctgtgttaaa

SEQ ID NO: 44599 - DNA, 24 bp, Homo sapiens
ttctgggatgcagttctgtgttaa

SEQ ID NO: 44600 - DNA, 24 bp, Homo sapiens
ggttcaagcgattctcctgcctca

SEQ ID NO: 44601 - DNA, 24 bp, Homo sapiens
cctttcctcctgagtgtgggttac

SEQ ID NO: 44602 - DNA, 24 bp, Homo sapiens
tgtgatattttgggcttagttcct

SEQ ID NO: 44603 - DNA, 24 bp, Homo sapiens
cttgcctgttgaagcccgagagaa

SEQ ID NO: 44604 - DNA, 24 bp, Homo sapiens
gccagcccagagcacctttacatt

SEQ ID NO: 44605 - DNA, 24 bp, Homo sapiens
actcacccacagtttcgttcaatt

SEQ ID NO: 44606 - DNA, 24 bp, Homo sapiens
gttcaagcaaggtaagtatcttaa

SEQ ID NO: 44607 - DNA, 24 bp, Homo sapiens
ggttcaagcaaggtaagtatctta

SEQ ID NO: 44608 - DNA, 24 bp, Homo sapiens
aggttcaagcaaggtaagtatctt

SEQ ID NO: 44609 - DNA, 24 bp, Homo sapiens
tttatgaaaagtctgttcaaaata

SEQ ID NO: 44610 - DNA, 24 bp, Homo sapiens
ttttatgaaaagtctgttcaaaat

SEQ ID NO: 44611 - DNA, 24 bp, Homo sapiens
gttttatgaaaagtctgttcaaaa

SEQ ID NO: 44612 - DNA, 24 bp, Homo sapiens
ccagcagcaacagcatcaaatact

SEQ ID NO: 44613 - DNA, 24 bp, Homo sapiens
aaagaatgactttccacctgcttg

SEQ ID NO: 44614 - DNA, 24 bp, Homo sapiens
gtcaacaccttatggccaacctgc

SEQ ID NO: 44615 - DNA, 24 bp, Homo sapiens
gtttccagcagcaacagcatcaaa

SEQ ID NO: 44616 - DNA, 24 bp, Homo sapiens
ttccacctgcttgtcagttgtcaa

SEQ ID NO: 44617 - DNA, 24 bp, Homo sapiens
gtaagacaccaagcagcaatacct

SEQ ID NO: 44618 - DNA, 24 bp, Homo sapiens
tatggaatcagattattcaggaca

SEQ ID NO: 44619 - DNA, 24 bp, Homo sapiens
atatggaatcagattattcaggac

SEQ ID NO: 44620 - DNA, 24 bp, Homo sapiens
gatatggaatcagattattcagga

SEQ ID NO: 44621 - DNA, 24 bp, Homo sapiens
tgaaaattcagcttcagcgagaac

SEQ ID NO: 44622 - DNA, 24 bp, Homo sapiens
ctgaaaattcagcttcagcgagaa

SEQ ID NO: 44623 - DNA, 24 bp, Homo sapiens
actgaaaattcagcttcagcgaga

SEQ ID NO: 44624 - DNA, 24 bp, Homo sapiens
taaaacaaaagctgacacctttat

SEQ ID NO: 44625 - DNA, 24 bp, Homo sapiens
ataaaacaaaagctgacaccttta

SEQ ID NO: 44626 - DNA, 24 bp, Homo sapiens
cataaaacaaaagctgacaccttt

SEQ ID NO: 44627 - DNA, 24 bp, Homo sapiens
gatttgttcaaaaattgcctgtgt

SEQ ID NO: 44628 - DNA, 24 bp, Homo sapiens
ggatttgttcaaaaattgcctgtg

SEQ ID NO: 44629 - DNA, 24 bp, Homo sapiens
tggatttgttcaaaaattgcctgt

SEQ ID NO: 44630 - DNA, 24 bp, Homo sapiens
catccagaaagagtccaccctgca

SEQ ID NO: 44631 - DNA, 24 bp, Homo sapiens
acatccagaaagagtccaccctgc

SEQ ID NO: 44632 - DNA, 24 bp, Homo sapiens
aacatccagaaagagtccaccctg

SEQ ID NO: 44633 - DNA, 24 bp, Homo sapiens
ttttaaactaggtcaaaatgcaga

SEQ ID NO: 44634 - DNA, 24 bp, Homo sapiens
cttttaaactaggtcaaaatgcag

SEQ ID NO: 44635 - DNA, 24 bp, Homo sapiens
acttttaaactaggtcaaaatgca

SEQ ID NO: 44636 - DNA, 24 bp, Homo sapiens
acgcaccctgtctgactacaacat

SEQ ID NO: 44637 - DNA, 24 bp, Homo sapiens
acaccatcgagaatgtcaaggcaa

SEQ ID NO: 44638 - DNA, 24 bp, Homo sapiens
gacaccatcgagaatgtcaaggca

SEQ ID NO: 44639 - DNA, 24 bp, Homo sapiens
tgacaccatcgagaatgtcaaggc

SEQ ID NO: 44640 - DNA, 24 bp, Homo sapiens
acctggtgctccgtctcagaggtg

SEQ ID NO: 44641 - DNA, 24 bp, Homo sapiens
cacctggtgctccgtctcagaggt

SEQ ID NO: 44642 - DNA, 24 bp, Homo sapiens
gcacctggtgctccgtctcagagg

SEQ ID NO: 44643 - DNA, 24 bp, Homo sapiens
atcgagaatgtcaaggcaaagatc

SEQ ID NO: 44644 - DNA, 24 bp, Homo sapiens
gataaggaaggcatccctcctgat

SEQ ID NO: 44645 - DNA, 24 bp, Homo sapiens
cagaggttgatctttgctgggaaa

SEQ ID NO: 44646 - DNA, 24 bp, Homo sapiens
cgagaatgtcaaggcaaagatcca

SEQ ID NO: 44647 - DNA, 24 bp, Homo sapiens
taaggaaggcatccctcctgatca

SEQ ID NO: 44648 - DNA, 24 bp, Homo sapiens
ccgtctcagaggtgggatgcaaat

SEQ ID NO: 44649 - DNA, 24 bp, Homo sapiens
tccgtctcagaggtgggatgcaaa

SEQ ID NO: 44650 - DNA, 24 bp, Homo sapiens
ctccgtctcagaggtgggatgcaa

SEQ ID NO: 44651 - DNA, 24 bp, Homo sapiens
ccagcagaggttgatctttgccgg

SEQ ID NO: 44652 - DNA, 24 bp, Homo sapiens
accagcagaggttgatctttgccg

SEQ ID NO: 44653 - DNA, 24 bp, Homo sapiens
gaccagcagaggttgatctttgcc

SEQ ID NO: 44654 - DNA, 24 bp, Homo sapiens
acagctggaaggatggacgcaccc

SEQ ID NO: 44655 - DNA, 24 bp, Homo sapiens
aacagctggaaggatggacgcacc

SEQ ID NO: 44656 - DNA, 24 bp, Homo sapiens
aaacagctggaaggatggacgcac

SEQ ID NO: 44657 - DNA, 24 bp, Homo sapiens
acgcaccctgtctgactacaacat

SEQ ID NO: 44658 - DNA, 24 bp, Homo sapiens
cctggtgctccgtctcagaggtgg

SEQ ID NO: 44659 - DNA, 24 bp, Homo sapiens
tcgtgaagaccctgactggtaaga

SEQ ID NO: 44660 - DNA, 24 bp, Homo sapiens
aaggcattcctcctgaccagcaga

SEQ ID NO: 44661 - DNA, 24 bp, Homo sapiens
cctggtactccgtctcagaggtgg

SEQ ID NO: 44662 - DNA, 24 bp, Homo sapiens
cctggtgctccgtctcagaggtgg

SEQ ID NO: 44663 - DNA, 24 bp, Homo sapiens
acgcaccctgtctgactacaacat

SEQ ID NO: 44664 - DNA, 24 bp, Homo sapiens
gatctttgctgggaaacagctgga

SEQ ID NO: 44665 - DNA, 24 bp, Homo sapiens
agagtccaccctgcacctggtgct

SEQ ID NO: 44666 - DNA, 24 bp, Homo sapiens
ctcctgaccagcagaggttgatct

SEQ ID NO: 44667 - DNA, 24 bp, Homo sapiens
acgcaccctgtctgactacaacat

SEQ ID NO: 44668 - DNA, 24 bp, Homo sapiens
cctggtgctccgtctcagaggtgg

SEQ ID NO: 44669 - DNA, 24 bp, Homo sapiens
gaaggcatccctcctgaccagcag

SEQ ID NO: 44670 - DNA, 24 bp, Homo sapiens
tgatctttgctgggaaacagctgg

SEQ ID NO: 44671 - DNA, 24 bp, Homo sapiens
agactctgactggtaagaccatca

SEQ ID NO: 44672 - DNA, 24 bp, Homo sapiens
tcgaggttgagcccagtgacacca

SEQ ID NO: 44673 - DNA, 24 bp, Homo sapiens
agaatgtcaaggcaaagatccaag

SEQ ID NO: 44674 - DNA, 24 bp, Homo sapiens
acaacatccagaaagagtccaccc

SEQ ID NO: 44675 - DNA, 24 bp, Homo sapiens
agctggaagatggacgcaccctgt

SEQ ID NO: 44676 - DNA, 24 bp, Homo sapiens
ctacaacatccagaaagagtccac

SEQ ID NO: 44677 - DNA, 24 bp, Homo sapiens
cctggtgctccgtcttagaggtgg

SEQ ID NO: 44678 - DNA, 24 bp, Homo sapiens
tcgtgaagaccctgactggtaaga

SEQ ID NO: 44679 - DNA, 24 bp, Homo sapiens
gctggaagatggtcgtaccctgtc

SEQ ID NO: 44680 - DNA, 24 bp, Homo sapiens
ggagcccagtgacaccatcgagaa

SEQ ID NO: 44681 - DNA, 24 bp, Homo sapiens
tcgtgaagaccctgactggtaaga

SEQ ID NO: 44682 - DNA, 24 bp, Homo sapiens
acaccatcgagaatgtcaaggcaa

SEQ ID NO: 44683 - DNA, 24 bp, Homo sapiens
tgctccgtctcagaggtgggatgc

SEQ ID NO: 44684 - DNA, 24 bp, Homo sapiens
acatccagaaagagtctaccctgc

SEQ ID NO: 44685 - DNA, 24 bp, Homo sapiens
aagatccaagataaggaaggcatt

SEQ ID NO: 44686 - DNA, 24 bp, Homo sapiens
tacaacatccagaaagagtccacc

SEQ ID NO: 44687 - DNA, 24 bp, Homo sapiens
gatcagcagaggttgatctttgcc

SEQ ID NO: 44688 - DNA, 24 bp, Homo sapiens
cctggtgctccgtctcagaggtgg

SEQ ID NO: 44689 - DNA, 24 bp, Homo sapiens
cgagaatgtcaaggcaaagatcca

SEQ ID NO: 44690 - DNA, 24 bp, Homo sapiens
accctgtctgactacaacatccag

SEQ ID NO: 44691 - DNA, 24 bp, Homo sapiens
tggacgcaccctgtctgactacaa

SEQ ID NO: 44692 - DNA, 24 bp, Homo sapiens
tgatctttgctgggaaacagctgg

SEQ ID NO: 44693 - DNA, 24 bp, Homo sapiens
cgagaatgtcaaggcaaagatcca

SEQ ID NO: 44694 - DNA, 24 bp, Homo sapiens
tcgagaatgtcaaggcaaagatcc

SEQ ID NO: 44695 - DNA, 24 bp, Homo sapiens
atcgagaatgtcaaggcaaagatc

SEQ ID NO: 44696 - DNA, 24 bp, Homo sapiens
ctcctgaccagcagaggttgatct

SEQ ID NO: 44697 - DNA, 24 bp, Homo sapiens
gctggaagatggtcgtaccctgtc

SEQ ID NO: 44698 - DNA, 24 bp, Homo sapiens
cgcaccctgtctgactacaacatc

SEQ ID NO: 44699 - DNA, 24 bp, Homo sapiens
gcagaggctgatctttgctggaaa

SEQ ID NO: 44700 - DNA, 24 bp, Homo sapiens
gagtccaccctgcacctggtgctc

SEQ ID NO: 44701 - DNA, 24 bp, Homo sapiens
gatcttcgtgaagactctgactgg

SEQ ID NO: 44702 - DNA, 24 bp, Homo sapiens
accctgcacctggtgctccgtctc

SEQ ID NO: 44703 - DNA, 24 bp, Homo sapiens
taccctgcacctggtgctccgtct

SEQ ID NO: 44704 - DNA, 24 bp, Homo sapiens
ctaccctgcacctggtgctccgtc

SEQ ID NO: 44705 - DNA, 24 bp, Homo sapiens
taccctgcacctggtgctccgtct

SEQ ID NO: 44706 - DNA, 24 bp, Homo sapiens
ctaccctgcacctggtgctccgtc

SEQ ID NO: 44707 - DNA, 24 bp, Homo sapiens
tctaccctgcacctggtgctccgt

SEQ ID NO: 44708 - DNA, 24 bp, Homo sapiens
ttcgtgaagaccctgactggtaag

SEQ ID NO: 44709 - DNA, 24 bp, Homo sapiens
aagtcatgaaggcctgctccggga

SEQ ID NO: 44710 - DNA, 24 bp, Homo sapiens
gaagtcatgaaggcctgctccggg

SEQ ID NO: 44711 - DNA, 24 bp, Homo sapiens
ggaagtcatgaaggcctgctccgg

SEQ ID NO: 44712 - DNA, 24 bp, Homo sapiens
tgcgggatttcaagcggttacaag

SEQ ID NO: 44713 - DNA, 24 bp, Homo sapiens
ggcggcggcgatccacagtgattc

SEQ ID NO: 44714 - DNA, 24 bp, Homo sapiens
cagggttgtttgtcagtctcggcg

SEQ ID NO: 44715 - DNA, 24 bp, Homo sapiens
ggcggcggcgatccacagtgattc

SEQ ID NO: 44716 - DNA, 24 bp, Homo sapiens
cagggttgtttgtcagtctcggcg

SEQ ID NO: 44717 - DNA, 24 bp, Homo sapiens
cagcactcacactgtggtagcggc

SEQ ID NO: 44718 - DNA, 23 bp, Homo sapiens
agtcttgctctgtcacccaggct

SEQ ID NO: 44719 - DNA, 25 bp, Homo sapiens
ggatgaatctccagaggatatgtga

SEQ ID NO: 44720 - DNA, 25 bp, Homo sapiens
tgagaagcaaagccaagatttaagt

SEQ ID NO: 44721 - DNA, 24 bp, Homo sapiens
gtgctggtcccaaaggcgataaca

SEQ ID NO: 44722 - DNA, 25 bp, Homo sapiens
tccgtgtatgagggtggtgtattct

SEQ ID NO: 44723 - DNA, 25 bp, Homo sapiens
tgaccaacagagcagaacatgacag

SEQ ID NO: 44724 - DNA, 24 bp, Homo sapiens
tatctccacagcaatcctatgagg

SEQ ID NO: 44725 - DNA, 24 bp, Homo sapiens
ttatctccacagcaatcctatgag

SEQ ID NO: 44726 - DNA, 24 bp, Homo sapiens
tttatctccacagcaatcctatga

SEQ ID NO: 44727 - DNA, 25 bp, Homo sapiens
aggagtaggagatggcacagttagc

SEQ ID NO: 44728 - DNA, 25 bp, Homo sapiens
acatgacacttacaagatggacagg

SEQ ID NO: 44729 - DNA, 23 bp, Homo sapiens
gcacctgtatcctagttccttgg

SEQ ID NO: 44730 - DNA, 24 bp, Homo sapiens
tgattttaaaggtaagatgtttta

SEQ ID NO: 44731 - DNA, 24 bp, Homo sapiens
ttgattttaaaggtaagatgtttt

SEQ ID NO: 44732 - DNA, 24 bp, Homo sapiens
attgattttaaaggtaagatgttt

SEQ ID NO: 44733 - DNA, 24 bp, Homo sapiens
ttagtgatcagatggttcagaatt

SEQ ID NO: 44734 - DNA, 24 bp, Homo sapiens
gttagtgatcagatggttcagaat

SEQ ID NO: 44735 - DNA, 24 bp, Homo sapiens
tgttagtgatcagatggttcagaa

SEQ ID NO: 44736 - DNA, 24 bp, Homo sapiens
agaagaagaagatgaaatatattc

SEQ ID NO: 44737 - DNA, 24 bp, Homo sapiens
gagaagaagaagatgaaatatatt

SEQ ID NO: 44738 - DNA, 24 bp, Homo sapiens
ggagaagaagaagatgaaatatat

SEQ ID NO: 44739 - DNA, 24 bp, Homo sapiens
gtgctggggctggaagaggagtct

SEQ ID NO: 44740 - DNA, 24 bp, Homo sapiens
tcggtgccagcgcctgcctgcgcg

SEQ ID NO: 44741 - DNA, 24 bp, Homo sapiens
ggctgggggtcgccggccagtggc

SEQ ID NO: 44742 - DNA, 24 bp, Homo sapiens
tgaatggtcacaatgcgatccttg

SEQ ID NO: 44743 - DNA, 24 bp, Homo sapiens
gtgaggatgctgaggatgactgcg

SEQ ID NO: 44744 - DNA, 24 bp, Homo sapiens
catactaccgaagaccttggaacg

SEQ ID NO: 44745 - DNA, 24 bp, Homo sapiens
tgatctatgaagaaaaaatgtttc

SEQ ID NO: 44746 - DNA, 24 bp, Homo sapiens
ttgatctatgaagaaaaaatgttt

SEQ ID NO: 44747 - DNA, 24 bp, Homo sapiens
tttgatctatgaagaaaaaatgtt

SEQ ID NO: 44748 - DNA, 24 bp, Homo sapiens
atccattttagatgacgtcccctg

SEQ ID NO: 44749 - DNA, 24 bp, Homo sapiens
gatccattttagatgacgtcccct

SEQ ID NO: 44750 - DNA, 24 bp, Homo sapiens
cgatccattttagatgacgtcccc

SEQ ID NO: 44751 - DNA, 24 bp, Homo sapiens
ataaacccaaattctctttcaaca

SEQ ID NO: 44752 - DNA, 24 bp, Homo sapiens
cataaacccaaattctctttcaac

SEQ ID NO: 44753 - DNA, 24 bp, Homo sapiens
ccataaacccaaattctctttcaa

SEQ ID NO: 44754 - DNA, 24 bp, Homo sapiens
attgtttatagtaattccagatac

SEQ ID NO: 44755 - DNA, 24 bp, Homo sapiens
gattgtttatagtaattccagata

SEQ ID NO: 44756 - DNA, 24 bp, Homo sapiens
agattgtttatagtaattccagat

SEQ ID NO: 44757 - DNA, 23 bp, Homo sapiens
gctcacaactgctccgccaacag

SEQ ID NO: 44758 - DNA, 23 bp, Homo sapiens
ctgacctgcgtggacctggatga

SEQ ID NO: 44759 - DNA, 25 bp, Homo sapiens
tctgaatgtcacagcaatgccacct

SEQ ID NO: 44760 - DNA, 24 bp, Homo sapiens
gcagtatgaaggaggtatctttaa

SEQ ID NO: 44761 - DNA, 24 bp, Homo sapiens
agcagtatgaaggaggtatcttta

SEQ ID NO: 44762 - DNA, 24 bp, Homo sapiens
aagcagtatgaaggaggtatcttt

SEQ ID NO: 44763 - DNA, 24 bp, Homo sapiens
atatatttcaggttgtcctgaaag

SEQ ID NO: 44764 - DNA, 24 bp, Homo sapiens
aatatatttcaggttgtcctgaaa

SEQ ID NO: 44765 - DNA, 24 bp, Homo sapiens
aaatatatttcaggttgtcctgaa

SEQ ID NO: 44766 - DNA, 24 bp, Homo sapiens
agaaattaaagttgctttaccgat

SEQ ID NO: 44767 - DNA, 24 bp, Homo sapiens
gagaaattaaagttgctttaccga

SEQ ID NO: 44768 - DNA, 24 bp, Homo sapiens
agagaaattaaagttgctttaccg

SEQ ID NO: 44769 - DNA, 24 bp, Homo sapiens
gcaagatgcggtactggttgcttc

SEQ ID NO: 44770 - DNA, 24 bp, Homo sapiens
aaaagcggaaaataaaatgaagat

SEQ ID NO: 44771 - DNA, 24 bp, Homo sapiens
ttttggcaattgtttatttctgca

SEQ ID NO: 44772 - DNA, 24 bp, Homo sapiens
ttccagcgattctcctgcctcagt

SEQ ID NO: 44773 - DNA, 24 bp, Homo sapiens
gctggactgaaagaggacacggga

SEQ ID NO: 44774 - DNA, 24 bp, Homo sapiens
gggcgggaactagagatggaggac

SEQ ID NO: 44775 - DNA, 24 bp, Homo sapiens
gcaggctggaggccagttctacgt

SEQ ID NO: 44776 - DNA, 24 bp, Homo sapiens
tgcaggctggaggccagttctacg

SEQ ID NO: 44777 - DNA, 24 bp, Homo sapiens
ttgcaggctggaggccagttctac

SEQ ID NO: 44778 - DNA, 24 bp, Homo sapiens
atttcttacaggtgcatcagacaa

SEQ ID NO: 44779 - DNA, 24 bp, Homo sapiens
aatttcttacaggtgcatcagaca

SEQ ID NO: 44780 - DNA, 24 bp, Homo sapiens
taatttcttacaggtgcatcagac

SEQ ID NO: 44781 - DNA, 25 bp, Homo sapiens
gccagcagataatgttacaagagga

SEQ ID NO: 44782 - DNA, 24 bp, Homo sapiens
gttgtgtgaccagtgcttcgggag

SEQ ID NO: 44783 - DNA, 23 bp, Homo sapiens
ttagcagcagcaccagcacaact

SEQ ID NO: 44784 - DNA, 24 bp, Homo sapiens
cactgggcactttgtttccttggc

SEQ ID NO: 44785 - DNA, 24 bp, Homo sapiens
ggctggtctcaaactcctgactcg

SEQ ID NO: 44786 - DNA, 24 bp, Homo sapiens
gctttctctccctcctatcttggc

SEQ ID NO: 44787 - DNA, 24 bp, Homo sapiens
ttattttctagaatgttctgaagg

SEQ ID NO: 44788 - DNA, 24 bp, Homo sapiens
tttattttctagaatgttctgaag

SEQ ID NO: 44789 - DNA, 24 bp, Homo sapiens
ttttattttctagaatgttctgaa

SEQ ID NO: 44790 - DNA, 24 bp, Homo sapiens
cttataattagcgtttagtatctg

SEQ ID NO: 44791 - DNA, 24 bp, Homo sapiens
tcttataattagcgtttagtatct

SEQ ID NO: 44792 - DNA, 24 bp, Homo sapiens
ttcttataattagcgtttagtatc

SEQ ID NO: 44793 - DNA, 24 bp, Homo sapiens
gtctggatctcctgacctcgtgat

SEQ ID NO: 44794 - DNA, 24 bp, Homo sapiens
tgcaagcgattaccagacggagtc

SEQ ID NO: 44795 - DNA, 24 bp, Homo sapiens
atctcggctcactgcaagctcctc

SEQ ID NO: 44796 - DNA, 24 bp, Homo sapiens
tgacggaaacaggcagaagatggt

SEQ ID NO: 44797 - DNA, 24 bp, Homo sapiens
agaggctactatgcttcaacatcg

SEQ ID NO: 44798 - DNA, 24 bp, Homo sapiens
cgctgagaagtggaacaggttgct

SEQ ID NO: 44799 - DNA, 24 bp, Homo sapiens
ctagtttaaagttcaatttcacat

SEQ ID NO: 44800 - DNA, 24 bp, Homo sapiens
tctagtttaaagttcaatttcaca

SEQ ID NO: 44801 - DNA, 24 bp, Homo sapiens
gtctagtttaaagttcaatttcac

SEQ ID NO: 44802 - DNA, 24 bp, Homo sapiens
ttttcttctagcacttggaacaac

SEQ ID NO: 44803 - DNA, 24 bp, Homo sapiens
cttttcttctagcacttggaacaa

SEQ ID NO: 44804 - DNA, 24 bp, Homo sapiens
tcttttcttctagcacttggaaca

SEQ ID NO: 44805 - DNA, 24 bp, Homo sapiens
ctctcgggtggcgggtttctaggc

SEQ ID NO: 44806 - DNA, 24 bp, Homo sapiens
gctgctctgcctcccggttctgcc

SEQ ID NO: 44807 - DNA, 24 bp, Homo sapiens
cctggatcgagatgagcgcctccg

SEQ ID NO: 44808 - DNA, 24 bp, Homo sapiens
gctatggggaggctggggagggtc

SEQ ID NO: 44809 - DNA, 24 bp, Homo sapiens
gaggagcccacccccgcatctgtc

SEQ ID NO: 44810 - DNA, 24 bp, Homo sapiens
ccgactagcaggactccctttccc

SEQ ID NO: 44811 - DNA, 24 bp, Homo sapiens
caacagtgggtcagttacgccgac

SEQ ID NO: 44812 - DNA, 24 bp, Homo sapiens
cccgactagcaggactccctttcc

SEQ ID NO: 44813 - DNA, 24 bp, Homo sapiens
cccagcctccgagccctcatagcc

SEQ ID NO: 44814 - DNA, 24 bp, Homo sapiens
aagaggcaaagaaacgggagaagc

SEQ ID NO: 44815 - DNA, 24 bp, Homo sapiens
atccaacagcagcagccacctcca

SEQ ID NO: 44816 - DNA, 24 bp, Homo sapiens
accagagaagagggagaaacggga

SEQ ID NO: 44817 - DNA, 24 bp, Homo sapiens
aattgttcaaggtgagtagaatgt

SEQ ID NO: 44818 - DNA, 24 bp, Homo sapiens
taattgttcaaggtgagtagaatg

SEQ ID NO: 44819 - DNA, 24 bp, Homo sapiens
ttaattgttcaaggtgagtagaat

SEQ ID NO: 44820 - DNA, 24 bp, Homo sapiens
ccagaggaaaggtaatacttacaa

SEQ ID NO: 44821 - DNA, 24 bp, Homo sapiens
accagaggaaaggtaatacttaca

SEQ ID NO: 44822 - DNA, 24 bp, Homo sapiens
caccagaggaaaggtaatacttac

SEQ ID NO: 44823 - DNA, 24 bp, Homo sapiens
cagcttcctccgttgccaagggcg

SEQ ID NO: 44824 - DNA, 24 bp, Homo sapiens
ctgcacccagcaccaccagcgccc

SEQ ID NO: 44825 - DNA, 24 bp, Homo sapiens
ccggacctgccgctgccgctgccg

SEQ ID NO: 44826 - DNA, 24 bp, Homo sapiens
gcttcctccgttgccaagggcggg

SEQ ID NO: 44827 - DNA, 24 bp, Homo sapiens
ggacctgccgctgccgctgccgac

SEQ ID NO: 44828 - DNA, 24 bp, Homo sapiens
ccacgctgcacccagcaccaccag

SEQ ID NO: 44829 - DNA, 24 bp, Homo sapiens
gctccgcctcgccctcagactccg

SEQ ID NO: 44830 - DNA, 24 bp, Homo sapiens
tgcgagatttcagtccaagtagcg

SEQ ID NO: 44831 - DNA, 24 bp, Homo sapiens
gagacggcggcagcagagacggaa

SEQ ID NO: 44832 - DNA, 24 bp, Homo sapiens
tctccgggagccagtccgcgccac

SEQ ID NO: 44833 - DNA, 24 bp, Homo sapiens
cccacacccaccgcgccctcgttc

SEQ ID NO: 44834 - DNA, 24 bp, Homo sapiens
gtccccgcgccagagacgcagccg

SEQ ID NO: 44835 - DNA, 24 bp, Homo sapiens
cctcgttcgcctcttctccgggag

SEQ ID NO: 44836 - DNA, 24 bp, Homo sapiens
ccgcgctcccaccacccacaccca

SEQ ID NO: 44837 - DNA, 24 bp, Homo sapiens
gccaccgccgccgcccaggccatc

SEQ ID NO: 44838 - DNA, 24 bp, Homo sapiens
tttccatcatcgtcaattttgtcc

SEQ ID NO: 44839 - DNA, 24 bp, Homo sapiens
atttccatcatcgtcaattttgtc

SEQ ID NO: 44840 - DNA, 24 bp, Homo sapiens
atttccatcatcgtcaattttgtc

SEQ ID NO: 44841 - DNA, 24 bp, Homo sapiens
tcacccagaatgccgatttcatct

SEQ ID NO: 44842 - DNA, 24 bp, Homo sapiens
cgctgctgacctgctggctgctcg

SEQ ID NO: 44843 - DNA, 24 bp, Homo sapiens
aatgtgcagagcttctgaggtctc

SEQ ID NO: 44844 - DNA, 24 bp, Homo sapiens
tcttcctctcttgctcttagtgat

SEQ ID NO: 44845 - DNA, 24 bp, Homo sapiens
ttcttcctctcttgctcttagtga

SEQ ID NO: 44846 - DNA, 24 bp, Homo sapiens
attcttcctctcttgctcttagtg

SEQ ID NO: 44847 - DNA, 24 bp, Homo sapiens
gtaaatatcccagagaacaatcac

SEQ ID NO: 44848 - DNA, 24 bp, Homo sapiens
tgtaaatatcccagagaacaatca

SEQ ID NO: 44849 - DNA, 24 bp, Homo sapiens
ctgtaaatatcccagagaacaatc

SEQ ID NO: 44850 - DNA, 24 bp, Homo sapiens
gctggctgaaggtggcagagcagc

SEQ ID NO: 44851 - DNA, 24 bp, Homo sapiens
ggctggctgaaggtggcagagcag

SEQ ID NO: 44852 - DNA, 24 bp, Homo sapiens
tggctggctgaaggtggcagagca

SEQ ID NO: 44853 - DNA, 24 bp, Homo sapiens
aagggaagaagttacagatttatg

SEQ ID NO: 44854 - DNA, 24 bp, Homo sapiens
caagggaagaagttacagatttat

SEQ ID NO: 44855 - DNA, 24 bp, Homo sapiens
tcaagggaagaagttacagattta

SEQ ID NO: 44856 - DNA, 24 bp, Homo sapiens
actgtgctctggatttgttaggat

SEQ ID NO: 44857 - DNA, 24 bp, Homo sapiens
aactgtgctctggatttgttagga

SEQ ID NO: 44858 - DNA, 24 bp, Homo sapiens
aaactgtgctctggatttgttagg

SEQ ID NO: 44859 - DNA, 24 bp, Homo sapiens
agtgagcctctccgtgtatcttgg

SEQ ID NO: 44860 - DNA, 24 bp, Homo sapiens
agtctccatgccctatgcctccaa

SEQ ID NO: 44861 - DNA, 24 bp, Homo sapiens
gatggcagcggcaactttcaagtc

SEQ ID NO: 44862 - DNA, 24 bp, Homo sapiens
caggtccaacagatttgttaggat

SEQ ID NO: 44863 - DNA, 24 bp, Homo sapiens
ccaggtccaacagatttgttagga

SEQ ID NO: 44864 - DNA, 24 bp, Homo sapiens
gccaggtccaacagatttgttagg

SEQ ID NO: 44865 - DNA, 24 bp, Homo sapiens
ggctgggcaggtcttgactcgtct

SEQ ID NO: 44866 - DNA, 24 bp, Homo sapiens
cggctgggcaggtcttgactcgtc

SEQ ID NO: 44867 - DNA, 24 bp, Homo sapiens
ccggctgggcaggtcttgactcgt

SEQ ID NO: 44868 - DNA, 23 bp, Homo sapiens
gctcaggctgctgctgctctcgg

SEQ ID NO: 44869 - DNA, 24 bp, Homo sapiens
tgctctggaaacactggaacaccc

SEQ ID NO: 44870 - DNA, 23 bp, Homo sapiens
ggatgctcaccaccgtcactgtg

SEQ ID NO: 44871 - DNA, 23 bp, Homo sapiens
agttgcgtgcatggtcagtgtgg

SEQ ID NO: 44872 - DNA, 23 bp, Homo sapiens
ctgcctggcggaacagaaccttc

SEQ ID NO: 44873 - DNA, 25 bp, Homo sapiens
cacatcttgagtggaacctcctgcg

SEQ ID NO: 44874 - DNA, 25 bp, Homo sapiens
tgaaggagaagcagcagcacattga

SEQ ID NO: 44875 - DNA, 23 bp, Homo sapiens
gctggctgaacgagacctggaac

SEQ ID NO: 44876 - DNA, 24 bp, Homo sapiens
ctgcgaggtggagaaggagattgc

SEQ ID NO: 44877 - DNA, 24 bp, Homo sapiens
gtggtatgtgctgctggtgctgaa

SEQ ID NO: 44878 - DNA, 24 bp, Homo sapiens
ttacctcggataccacaagtgctt

SEQ ID NO: 44879 - DNA, 24 bp, Homo sapiens
agagaagaccttcagcaatggcac

SEQ ID NO: 44880 - DNA, 24 bp, Homo sapiens
ttcacaagagatgctccgctacaa

SEQ ID NO: 44881 - DNA, 24 bp, Homo sapiens
ggtcctgctcgtgttgcctgtgtc

SEQ ID NO: 44882 - DNA, 24 bp, Homo sapiens
cgaggaagacaactgctgtggctg

SEQ ID NO: 44883 - DNA, 24 bp, Homo sapiens
gtgcgagagtgccagttccagttc

SEQ ID NO: 44884 - DNA, 24 bp, Homo sapiens
ggttatggaccctaccagcatctg

SEQ ID NO: 44885 - DNA, 24 bp, Homo sapiens
gctgctgctgctgctgctcctgtg

SEQ ID NO: 44886 - DNA, 24 bp, Homo sapiens
cgaggagatgctagagggcgcagc

SEQ ID NO: 44887 - DNA, 24 bp, Homo sapiens
ctggccgggctctgcctgctggcg

SEQ ID NO: 44888 - DNA, 24 bp, Homo sapiens
agcaccatgcgccccccgcccgcg

SEQ ID NO: 44889 - DNA, 24 bp, Homo sapiens
actgggcgtggttgctggtgctca

SEQ ID NO: 44890 - DNA, 24 bp, Homo sapiens
tagcggacccagcacagccaggag

SEQ ID NO: 44891 - DNA, 24 bp, Homo sapiens
tgtttggatgcaatgttcttagga

SEQ ID NO: 44892 - DNA, 24 bp, Homo sapiens
gtcaaaacaaggtaaggatttaat

SEQ ID NO: 44893 - DNA, 24 bp, Homo sapiens
tgtcaaaacaaggtaaggatttaa

SEQ ID NO: 44894 - DNA, 24 bp, Homo sapiens
ttgtcaaaacaaggtaaggattta

SEQ ID NO: 44895 - DNA, 24 bp, Homo sapiens
aggtaaaacaagtgcgtaaacttt

SEQ ID NO: 44896 - DNA, 24 bp, Homo sapiens
caggtaaaacaagtgcgtaaactt

SEQ ID NO: 44897 - DNA, 24 bp, Homo sapiens
acaggtaaaacaagtgcgtaaact

SEQ ID NO: 44898 - DNA, 24 bp, Homo sapiens
tagaagaagagaaccaaaaacttt

SEQ ID NO: 44899 - DNA, 24 bp, Homo sapiens
ttagaagaagagaaccaaaaactt

SEQ ID NO: 44900 - DNA, 24 bp, Homo sapiens
tttagaagaagagaaccaaaaact

SEQ ID NO: 44901 - DNA, 24 bp, Homo sapiens
atcattggtgctgtggttgctgac

SEQ ID NO: 44902 - DNA, 24 bp, Homo sapiens
tcacctatgaagaactaccagcca

SEQ ID NO: 44903 - DNA, 24 bp, Homo sapiens
tccgaagcagataatgttgtgtca

SEQ ID NO: 44904 - DNA, 24 bp, Homo sapiens
agagaaagaagtgaaaagataaaa

SEQ ID NO: 44905 - DNA, 24 bp, Homo sapiens
aagagaaagaagtgaaaagataaa

SEQ ID NO: 44906 - DNA, 24 bp, Homo sapiens
caagagaaagaagtgaaaagataa

SEQ ID NO: 44907 - DNA, 24 bp, Homo sapiens
atttgttgcagtgaaaagataaaa

SEQ ID NO: 44908 - DNA, 24 bp, Homo sapiens
tatttgttgcagtgaaaagataaa

SEQ ID NO: 44909 - DNA, 24 bp, Homo sapiens
ctatttgttgcagtgaaaagataa

SEQ ID NO: 44910 - DNA, 24 bp, Homo sapiens
ggaccacagacatcaccagaacag

SEQ ID NO: 44911 - DNA, 24 bp, Homo sapiens
ggatgctggtctcaattatggtca

SEQ ID NO: 44912 - DNA, 24 bp, Homo sapiens
cacggcattggcaacttcctgtgt

SEQ ID NO: 44913 - DNA, 24 bp, Homo sapiens
acagcggtggcagcggagatgaag

SEQ ID NO: 44914 - DNA, 24 bp, Homo sapiens
catcgtgcgtaaggagtgggtgct

SEQ ID NO: 44915 - DNA, 24 bp, Homo sapiens
acctcatctgtgcctttgccaaca

SEQ ID NO: 44916 - DNA, 24 bp, Homo sapiens
gtggtagtggtgctgagtggcttc

SEQ ID NO: 44917 - DNA, 24 bp, Homo sapiens
acctcatctgtgcctttgccaaca

SEQ ID NO: 44918 - DNA, 24 bp, Homo sapiens
catcgtgcgtaaggagtgggtgct

SEQ ID NO: 44919 - DNA, 24 bp, Homo sapiens
aattaagaaagccaaactgaaatc

SEQ ID NO: 44920 - DNA, 24 bp, Homo sapiens
caattaagaaagccaaactgaaat

SEQ ID NO: 44921 - DNA, 24 bp, Homo sapiens
gcaattaagaaagccaaactgaaa

SEQ ID NO: 44922 - DNA, 24 bp, Homo sapiens
cctggaggctggagccgtctacat

SEQ ID NO: 44923 - DNA, 24 bp, Homo sapiens
gcctggaggctggagccgtctaca

SEQ ID NO: 44924 - DNA, 24 bp, Homo sapiens
ggcctggaggctggagccgtctac

SEQ ID NO: 44925 - DNA, 24 bp, Homo sapiens
agatgcctcagtcaagtcagccaa

SEQ ID NO: 44926 - DNA, 24 bp, Homo sapiens
gatgacacggacacctcggctgct

SEQ ID NO: 44927 - DNA, 24 bp, Homo sapiens
agacttgaagagactgaccaacct

SEQ ID NO: 44928 - DNA, 24 bp, Homo sapiens
agatgcctcagtcaagtcagccaa

SEQ ID NO: 44929 - DNA, 24 bp, Homo sapiens
gatgacacggacacctcggctgct

SEQ ID NO: 44930 - DNA, 24 bp, Homo sapiens
cccacaggctttgaattgaaggcg

SEQ ID NO: 44931 - DNA, 24 bp, Homo sapiens
gctggatttccgaggctggaggcg

SEQ ID NO: 44932 - DNA, 24 bp, Homo sapiens
cgagacccccgccgccaccgccag

SEQ ID NO: 44933 - DNA, 24 bp, Homo sapiens
cgcgccgctgagccgagcgccccc

SEQ ID NO: 44934 - DNA, 24 bp, Homo sapiens
tgacctcagcagccgattcagcaa

SEQ ID NO: 44935 - DNA, 24 bp, Homo sapiens
ttctcacttggcaaggaagatgga

SEQ ID NO: 44936 - DNA, 24 bp, Homo sapiens
agaaggtgaagatgggttggatga

SEQ ID NO: 44937 - DNA, 24 bp, Homo sapiens
gccctcataaagtaagtaatgcta

SEQ ID NO: 44938 - DNA, 24 bp, Homo sapiens
tgccctcataaagtaagtaatgct

SEQ ID NO: 44939 - DNA, 24 bp, Homo sapiens
ttgccctcataaagtaagtaatgc

SEQ ID NO: 44940 - DNA, 23 bp, Homo sapiens
ggaggaagcaggcgtgtgttgaa

SEQ ID NO: 44941 - DNA, 25 bp, Homo sapiens
aataaacaggaagcgacaagcaccc

SEQ ID NO: 44942 - DNA, 23 bp, Homo sapiens
gccctgcacagcctttaggaagc

SEQ ID NO: 44943 - DNA, 23 bp, Homo sapiens
ccagcagcagtatggcttccagt

SEQ ID NO: 44944 - DNA, 23 bp, Homo sapiens
caacaacagcagcagcagcctcc

SEQ ID NO: 44945 - DNA, 23 bp, Homo sapiens
gtatgatgccgccaccacctatg

SEQ ID NO: 44946 - DNA, 24 bp, Homo sapiens
gtttgttgggtgaactttgaggcg

SEQ ID NO: 44947 - DNA, 24 bp, Homo sapiens
ggactacccagttacaagcgtctt

SEQ ID NO: 44948 - DNA, 24 bp, Homo sapiens
cctgtgaagagtgcctgaagaacg

SEQ ID NO: 44949 - DNA, 24 bp, Homo sapiens
gtaccaaacagcaataattattgg

SEQ ID NO: 44950 - DNA, 24 bp, Homo sapiens
agtaccaaacagcaataattattg

SEQ ID NO: 44951 - DNA, 24 bp, Homo sapiens
cagtaccaaacagcaataattatt

SEQ ID NO: 44952 - DNA, 24 bp, Homo sapiens
tgaagatttaagtaataattctga

SEQ ID NO: 44953 - DNA, 24 bp, Homo sapiens
atgaagatttaagtaataattctg

SEQ ID NO: 44954 - DNA, 24 bp, Homo sapiens
gatgaagatttaagtaataattct

SEQ ID NO: 44955 - DNA, 24 bp, Homo sapiens
tgttgaaataggtggaacagaaat

SEQ ID NO: 44956 - DNA, 24 bp, Homo sapiens
atgttgaaataggtggaacagaaa

SEQ ID NO: 44957 - DNA, 24 bp, Homo sapiens
gatgttgaaataggtggaacagaa

SEQ ID NO: 44958 - DNA, 24 bp, Homo sapiens
cagggagcagaggggacagaggca

SEQ ID NO: 44959 - DNA, 24 bp, Homo sapiens
gctggagcagggagaagagccatg

SEQ ID NO: 44960 - DNA, 24 bp, Homo sapiens
gattcctggttttcaagcctgagc

SEQ ID NO: 44961 - DNA, 24 bp, Homo sapiens
gactcacctctgacgccgctcttc

SEQ ID NO: 44962 - DNA, 24 bp, Homo sapiens
tgctgttgctgctgcctttgtgac

SEQ ID NO: 44963 - DNA, 24 bp, Homo sapiens
cgctggtgaatggagtcgcgttct

SEQ ID NO: 44964 - DNA, 24 bp, Homo sapiens
cactctgctgtcactcaaggaagt

SEQ ID NO: 44965 - DNA, 24 bp, Homo sapiens
tttgctgttgctgctgcctttgtg

SEQ ID NO: 44966 - DNA, 24 bp, Homo sapiens
gactcacctctgacgccgctcttc

SEQ ID NO: 44967 - DNA, 24 bp, Homo sapiens
aaatgaacaaggtaagttgtttat

SEQ ID NO: 44968 - DNA, 24 bp, Homo sapiens
aaaatgaacaaggtaagttgttta

SEQ ID NO: 44969 - DNA, 24 bp, Homo sapiens
caaaatgaacaaggtaagttgttt

SEQ ID NO: 44970 - DNA, 24 bp, Homo sapiens
agagatgtgatgctggagaactac

SEQ ID NO: 44971 - DNA, 24 bp, Homo sapiens
aggaggagtggcagcacctggacc

SEQ ID NO: 44972 - DNA, 24 bp, Homo sapiens
acaaggtagatcagaagttccagg

SEQ ID NO: 44973 - DNA, 24 bp, Homo sapiens
gcgatgtgatgctggagaactttg

SEQ ID NO: 44974 - DNA, 24 bp, Homo sapiens
ttcttaatgacgttcagagacacc

SEQ ID NO: 44975 - DNA, 24 bp, Homo sapiens
ggccatacatttctcccaggagga

SEQ ID NO: 44976 - DNA, 24 bp, Homo sapiens
tgttgcctagggctggagtgcagt

SEQ ID NO: 44977 - DNA, 24 bp, Homo sapiens
ctgttgcctagggctggagtgcag

SEQ ID NO: 44978 - DNA, 24 bp, Homo sapiens
tctgttgcctagggctggagtgca

SEQ ID NO: 44979 - DNA, 24 bp, Homo sapiens
caggacagtcgggactggaattgc

SEQ ID NO: 44980 - DNA, 24 bp, Homo sapiens
gcaggacagtcgggactggaattg

SEQ ID NO: 44981 - DNA, 24 bp, Homo sapiens
tgcaggacagtcgggactggaatt

SEQ ID NO: 44982 - DNA, 24 bp, Homo sapiens
gagcagttcctgacaatcttgcct

SEQ ID NO: 44983 - DNA, 24 bp, Homo sapiens
gctgtggccttggtggaggattgg

SEQ ID NO: 44984 - DNA, 24 bp, Homo sapiens
tgcaggcacgccaccctgagagtg

SEQ ID NO: 44985 - DNA, 24 bp, Homo sapiens
taggattacagaaaaagaaaactc

SEQ ID NO: 44986 - DNA, 24 bp, Homo sapiens
ctaggattacagaaaaagaaaact

SEQ ID NO: 44987 - DNA, 24 bp, Homo sapiens
gctaggattacagaaaaagaaaac

SEQ ID NO: 44988 - DNA, 23 bp, Homo sapiens
cggttgagtccacagatgccagc

SEQ ID NO: 44989 - DNA, 25 bp, Homo sapiens
gctcatgtgaggcttcagtgtcatt

SEQ ID NO: 44990 - DNA, 23 bp, Homo sapiens
ttcagcaaggaggagtggcagca

SEQ ID NO: 44991 - DNA, 24 bp, Homo sapiens
ggtctcagtggggcatcagtccac

SEQ ID NO: 44992 - DNA, 24 bp, Homo sapiens
tggtctcagtggggcatcagtcca

SEQ ID NO: 44993 - DNA, 24 bp, Homo sapiens
gtggtctcagtggggcatcagtcc

SEQ ID NO: 44994 - DNA, 24 bp, Homo sapiens
acgaagtctaaggaggcagtgaca

SEQ ID NO: 44995 - DNA, 24 bp, Homo sapiens
cgtggctgtggtcttctctgagga

SEQ ID NO: 44996 - DNA, 24 bp, Homo sapiens
accgagatgtgatgctggagaact

SEQ ID NO: 44997 - DNA, 24 bp, Homo sapiens
ttaaaacaaaggtgttgaaattcc

SEQ ID NO: 44998 - DNA, 24 bp, Homo sapiens
attaaaacaaaggtgttgaaattc

SEQ ID NO: 44999 - DNA, 24 bp, Homo sapiens
cattaaaacaaaggtgttgaaatt

SEQ ID NO: 45000 - DNA, 24 bp, Homo sapiens
ttaagacaaagatggccaagctgc

SEQ ID NO: 45001 - DNA, 24 bp, Homo sapiens
attaagacaaagatggccaagctg

SEQ ID NO: 45002 - DNA, 24 bp, Homo sapiens
gattaagacaaagatggccaagct

SEQ ID NO: 45003 - DNA, 24 bp, Homo sapiens
attctcacttgtgccacgacaggt

SEQ ID NO: 45004 - DNA, 24 bp, Homo sapiens
ctattctcccgcctcaacctccca

SEQ ID NO: 45005 - DNA, 24 bp, Homo sapiens
cgcccaatcatttgttcccactca

SEQ ID NO: 45006 - DNA, 24 bp, Homo sapiens
ctattctcccgcctcaacctccca

SEQ ID NO: 45007 - DNA, 24 bp, Homo sapiens
ccagtttcccagaagcatccagca

SEQ ID NO: 45008 - DNA, 24 bp, Homo sapiens
gaatctcactctgtcacccaggcg

SEQ ID NO: 45009 - DNA, 24 bp, Homo sapiens
tcccgaagccaggtccaaggaatc

SEQ ID NO: 45010 - DNA, 24 bp, Homo sapiens
tcaaggatgtggctgtggacttca

SEQ ID NO: 45011 - DNA, 24 bp, Homo sapiens
cgggatgtgatgttggagaactac

SEQ ID NO: 45012 - DNA, 24 bp, Homo sapiens
ctattctcccgcctcaacctccca

SEQ ID NO: 45013 - DNA, 24 bp, Homo sapiens
ccagtttcccagaagcatccagca

SEQ ID NO: 45014 - DNA, 24 bp, Homo sapiens
cgcccaatcatttgttcccactca

SEQ ID NO: 45015 - DNA, 24 bp, Homo sapiens
cgggatgtgatgttggagaactac

SEQ ID NO: 45016 - DNA, 24 bp, Homo sapiens
tcaaggatgtggctgtggacttca

SEQ ID NO: 45017 - DNA, 24 bp, Homo sapiens
ggtcaactagactcccctcagagg

SEQ ID NO: 45018 - DNA, 24 bp, Homo sapiens
gatgtggctgtggacttcacccag

SEQ ID NO: 45019 - DNA, 24 bp, Homo sapiens
cgggatgtgatgttggagaactac

SEQ ID NO: 45020 - DNA, 24 bp, Homo sapiens
ggtcaactagactcccctcagagg

SEQ ID NO: 45021 - DNA, 24 bp, Homo sapiens
ggaccgtaagacagtgagtgctga

SEQ ID NO: 45022 - DNA, 24 bp, Homo sapiens
ctccgccacctcctcacgcttctg

SEQ ID NO: 45023 - DNA, 24 bp, Homo sapiens
ggctggaagatcagtaggcaaggc

SEQ ID NO: 45024 - DNA, 24 bp, Homo sapiens
gttctcacctcacacgacagcatg

SEQ ID NO: 45025 - DNA, 24 bp, Homo sapiens
gagatggagtcttgctctgtcacc

SEQ ID NO: 45026 - DNA, 24 bp, Homo sapiens
tggctttgttcaccctccctggac

SEQ ID NO: 45027 - DNA, 24 bp, Homo sapiens
gcactcacagtctaaggctggaag

SEQ ID NO: 45028 - DNA, 24 bp, Homo sapiens
atggcattcagggatgtggctgtg

SEQ ID NO: 45029 - DNA, 24 bp, Homo sapiens
ccaggatgagtggaggctgctgag

SEQ ID NO: 45030 - DNA, 24 bp, Homo sapiens
aagttctgctgcctgagagtaacg

SEQ ID NO: 45031 - DNA, 24 bp, Homo sapiens
gagaggtgatgctggagaactaca

SEQ ID NO: 45032 - DNA, 24 bp, Homo sapiens
gcactcacagtctaaggctggaag

SEQ ID NO: 45033 - DNA, 24 bp, Homo sapiens
gcactcacagtctaaggctggaag

SEQ ID NO: 45034 - DNA, 24 bp, Homo sapiens
ccaggatgagtggaggctgctgag

SEQ ID NO: 45035 - DNA, 24 bp, Homo sapiens
gagaggtgatgctggagaactaca

SEQ ID NO: 45036 - DNA, 24 bp, Homo sapiens
ttttgtaagtttttcagagtcaag

SEQ ID NO: 45037 - DNA, 24 bp, Homo sapiens
cttttgtaagtttttcagagtcaa

SEQ ID NO: 45038 - DNA, 24 bp, Homo sapiens
tcttttgtaagtttttcagagtca

SEQ ID NO: 45039 - DNA, 24 bp, Homo sapiens
ccgcctgcatgtggatggtgtccc

SEQ ID NO: 45040 - DNA, 24 bp, Homo sapiens
accgcctgcatgtggatggtgtcc

SEQ ID NO: 45041 - DNA, 24 bp, Homo sapiens
taccgcctgcatgtggatggtgtc

SEQ ID NO: 45042 - DNA, 24 bp, Homo sapiens
cataagaaaatataagaaaattca

SEQ ID NO: 45043 - DNA, 24 bp, Homo sapiens
acataagaaaatataagaaaattc

SEQ ID NO: 45044 - DNA, 24 bp, Homo sapiens
aacataagaaaatataagaaaatt

SEQ ID NO: 45045 - DNA, 24 bp, Homo sapiens
cccgaacccagatggccgaaacgg

SEQ ID NO: 45046 - DNA, 24 bp, Homo sapiens
ccccgaacccagatggccgaaacg

SEQ ID NO: 45047 - DNA, 24 bp, Homo sapiens
accccgaacccagatggccgaaac

SEQ ID NO: 45048 - DNA, 25 bp, Homo sapiens
ggagacacacaggcagacccatact

SEQ ID NO: 45049 - DNA, 23 bp, Homo sapiens
gccgtcttctgtctgctgtgtgg

SEQ ID NO: 45050 - DNA, 24 bp, Homo sapiens
cctacgagtgtgagttctgtggca

SEQ ID NO: 45051 - DNA, 24 bp, Homo sapiens
acaagtgcgaggactgtgggaagg

SEQ ID NO: 45052 - DNA, 24 bp, Homo sapiens
cacaagtgcgaggactgtgggaag

SEQ ID NO: 45053 - DNA, 24 bp, Homo sapiens
ccacaagtgcgaggactgtgggaa

SEQ ID NO: 45054 - DNA, 25 bp, Homo sapiens
ggaccgctgaatattaccgctaccg

SEQ ID NO: 45055 - DNA, 24 bp, Homo sapiens
cggcaggtccagaagttcgatgag

SEQ ID NO: 45056 - DNA, 24 bp, Homo sapiens
actgagtctgggcatcatcctctc

SEQ ID NO: 45057 - DNA, 24 bp, Homo sapiens
ttgcttacagagaagtgaactcct

SEQ ID NO: 45058 - DNA, 24 bp, Homo sapiens
agattctggaactgctggtgctag

SEQ ID NO: 45059 - DNA, 24 bp, Homo sapiens
gagagtggagaggaggcagtgacc

SEQ ID NO: 45060 - DNA, 24 bp, Homo sapiens
tgctctcaagtgatcctcctgcct

SEQ ID NO: 45061 - DNA, 24 bp, Homo sapiens
gctctgcctgcttaggactctgcc

SEQ ID NO: 45062 - DNA, 24 bp, Homo sapiens
acctacaggaggaagaatggctgc

SEQ ID NO: 45063 - DNA, 24 bp, Homo sapiens
gcgtcttagtgctccttagtgtct

SEQ ID NO: 45064 - DNA, 24 bp, Homo sapiens
ctcaagccatcctcctgcctcagc

SEQ ID NO: 45065 - DNA, 24 bp, Homo sapiens
gacacaatcctagctcactgccgc

SEQ ID NO: 45066 - DNA, 24 bp, Homo sapiens
taggaagagcaacagcacagcagc

SEQ ID NO: 45067 - DNA, 24 bp, Homo sapiens
ggatgcaaaggcagacccaaaggg

SEQ ID NO: 45068 - DNA, 24 bp, Homo sapiens
ggctgattgtgaggggaaggatgt

SEQ ID NO: 45069 - DNA, 24 bp, Homo sapiens
agctgaccaaggatgaagaggaga

SEQ ID NO: 45070 - DNA, 24 bp, Homo sapiens
gagctgaccaaggatgaagaggag

SEQ ID NO: 45071 - DNA, 24 bp, Homo sapiens
agagctgaccaaggatgaagagga

SEQ ID NO: 45072 - DNA, 24 bp, Homo sapiens
tttatcatccacacggggcagtcg

SEQ ID NO: 45073 - DNA, 24 bp, Homo sapiens
ctgacctcccagtctcaccctctc

SEQ ID NO: 45074 - DNA, 24 bp, Homo sapiens
cgaattggctctgacccttacctg

SEQ ID NO: 45075 - DNA, 24 bp, Homo sapiens
actgagggctgtgcgtgtgctgag

SEQ ID NO: 45076 - DNA, 24 bp, Homo sapiens
gctgcttctcttctttgccatcct

SEQ ID NO: 45077 - DNA, 24 bp, Homo sapiens
tgccatcttgacggtgttccagtg

SEQ ID NO: 45078 - DNA, 24 bp, Homo sapiens
tacatatcccagtgatgctgacgg

SEQ ID NO: 45079 - DNA, 24 bp, Homo sapiens
gaacgtcactcgcatgggcagtca

SEQ ID NO: 45080 - DNA, 24 bp, Homo sapiens
cacacactgcccagcacctgtctc

SEQ ID NO: 45081 - DNA, 24 bp, Homo sapiens
aagagccctggaatgtgaagagac

SEQ ID NO: 45082 - DNA, 24 bp, Homo sapiens
ccgttggtctcactgtctgtaagc

SEQ ID NO: 45083 - DNA, 24 bp, Homo sapiens
ggatgtgatgttggagaactacag

SEQ ID NO: 45084 - DNA, 24 bp, Homo sapiens
cttcgccatgctcacggtgttcca

SEQ ID NO: 45085 - DNA, 24 bp, Homo sapiens
cccaagcacggcatcaccaacttt

SEQ ID NO: 45086 - DNA, 24 bp, Homo sapiens
ggcatagcagatgttccagcagaa

SEQ ID NO: 45087 - DNA, 23 bp, Homo sapiens
ctcctccgcctcctcctcctcac

SEQ ID NO: 45088 - DNA, 23 bp, Homo sapiens
ggactggaccgagcggagttgtg

SEQ ID NO: 45089 - DNA, 23 bp, Homo sapiens
gggggaggggaggttcgttccgc

SEQ ID NO: 45090 - DNA, 25 bp, Homo sapiens
ggtagaatgaatgtggcaggagacg

SEQ ID NO: 45091 - DNA, 25 bp, Homo sapiens
acagaccaagactggagtaggacct

SEQ ID NO: 45092 - DNA, 25 bp, Homo sapiens
actgacgggcgagatatgaacttaa

SEQ ID NO: 45093 - DNA, 24 bp, Homo sapiens
gaaaacacaaggtaaatattggga

SEQ ID NO: 45094 - DNA, 24 bp, Homo sapiens
agaaaacacaaggtaaatattggg

SEQ ID NO: 45095 - DNA, 24 bp, Homo sapiens
cagaaaacacaaggtaaatattgg

SEQ ID NO: 45096 - DNA, 25 bp, Homo sapiens
aagacatggatgaaagacgacgact

SEQ ID NO: 45097 - DNA, 25 bp, Homo sapiens
gcaatacctggaagaacagacatag

SEQ ID NO: 45098 - DNA, 23 bp, Homo sapiens
aatatatggtatggaaggtattc

SEQ ID NO: 45099 - DNA, 25 bp, Homo sapiens
tgagaagatccttattcagcaccaa

SEQ ID NO: 45100 - DNA, 25 bp, Homo sapiens
gccgtggtgctggtattgtaataga

SEQ ID NO: 45101 - DNA, 25 bp, Homo sapiens
cggtagaacacagttatgggtcgca

SEQ ID NO: 45102 - DNA, 24 bp, Homo sapiens
gcggctcctatctcttggtgatcc

SEQ ID NO: 45103 - DNA, 24 bp, Homo sapiens
aaatgcagcatcaacggcagcagc

SEQ ID NO: 45104 - DNA, 24 bp, Homo sapiens
attccgcccccgcctcaacgccca

SEQ ID NO: 45105 - DNA, 24 bp, Homo sapiens
atgtgttcaaaaacccgctattat

SEQ ID NO: 45106 - DNA, 24 bp, Homo sapiens
gatgtgttcaaaaacccgctatta

SEQ ID NO: 45107 - DNA, 24 bp, Homo sapiens
tgatgtgttcaaaaacccgctatt

SEQ ID NO: 45108 - DNA, 24 bp, Homo sapiens
cagccatagcgcccagcctcctgc

SEQ ID NO: 45109 - DNA, 24 bp, Homo sapiens
acagccatagcgcccagcctcctg

SEQ ID NO: 45110 - DNA, 24 bp, Homo sapiens
cacagccatagcgcccagcctcct

SEQ ID NO: 45111 - DNA, 24 bp, Homo sapiens
gtatattccagtgttcatcatttg

SEQ ID NO: 45112 - DNA, 24 bp, Homo sapiens
tgtatattccagtgttcatcattt

SEQ ID NO: 45113 - DNA, 24 bp, Homo sapiens
ttgtatattccagtgttcatcatt

SEQ ID NO: 45114 - DNA, 24 bp, Homo sapiens
atatgttcaagggcatccaccctt

SEQ ID NO: 45115 - DNA, 24 bp, Homo sapiens
aatatgttcaagggcatccaccct

SEQ ID NO: 45116 - DNA, 24 bp, Homo sapiens
gaatatgttcaagggcatccaccc

SEQ ID NO: 45117 - DNA, 24 bp, Homo sapiens
ttgattttggggtcacagtgggca

SEQ ID NO: 45118 - DNA, 24 bp, Homo sapiens
tttgattttggggtcacagtgggc

SEQ ID NO: 45119 - DNA, 24 bp, Homo sapiens
ctttgattttggggtcacagtggg

SEQ ID NO: 45120 - DNA, 24 bp, Homo sapiens
ccgagatgtgatgctggagaactt

SEQ ID NO: 45121 - DNA, 24 bp, Homo sapiens
tgctgtggtcttcactgaggagga

SEQ ID NO: 45122 - DNA, 24 bp, Homo sapiens
gctgctggactctgtccagaggaa

SEQ ID NO: 45123 - DNA, 24 bp, Homo sapiens
aggctgtgactgtgctggaggatt

SEQ ID NO: 45124 - DNA, 24 bp, Homo sapiens
caacgcttcaggcatctccgctac

SEQ ID NO: 45125 - DNA, 24 bp, Homo sapiens
agatcctggagttcctggtgctgg

SEQ ID NO: 45126 - DNA, 24 bp, Homo sapiens
atttttattaggagttagaccttt

SEQ ID NO: 45127 - DNA, 24 bp, Homo sapiens
catttttattaggagttagacctt

SEQ ID NO: 45128 - DNA, 24 bp, Homo sapiens
tcatttttattaggagttagacct

SEQ ID NO: 45129 - DNA, 24 bp, Homo sapiens
cgctcttacaggtgtgactattgc

SEQ ID NO: 45130 - DNA, 24 bp, Homo sapiens
gcgctcttacaggtgtgactattg

SEQ ID NO: 45131 - DNA, 24 bp, Homo sapiens
ggcgctcttacaggtgtgactatt

SEQ ID NO: 45132 - DNA, 24 bp, Homo sapiens
atgttttaacggtaagtttagtaa

SEQ ID NO: 45133 - DNA, 24 bp, Homo sapiens
catgttttaacggtaagtttagta

SEQ ID NO: 45134 - DNA, 24 bp, Homo sapiens
tcatgttttaacggtaagtttagt

SEQ ID NO: 45135 - DNA, 24 bp, Homo sapiens
agctcttcaaggggaaattctaca

SEQ ID NO: 45136 - DNA, 24 bp, Homo sapiens
cagctcttcaaggggaaattctac

SEQ ID NO: 45137 - DNA, 24 bp, Homo sapiens
gcagctcttcaaggggaaattcta

SEQ ID NO: 45138 - DNA, 24 bp, Homo sapiens
gtcctgagtggggagttctccaag

SEQ ID NO: 45139 - DNA, 24 bp, Homo sapiens
cgtcctgagtggggagttctccaa

SEQ ID NO: 45140 - DNA, 24 bp, Homo sapiens
gcgtcctgagtggggagttctcca

SEQ ID NO: 45141 - DNA, 24 bp, Homo sapiens
tcttgccattgctgtggacaacct

SEQ ID NO: 45142 - DNA, 24 bp, Homo sapiens
tcatctgtggcaactacatcctgt

SEQ ID NO: 45143 - DNA, 24 bp, Homo sapiens
tgaccagacccacaccaagcgaag

SEQ ID NO: 45144 - DNA, 24 bp, Homo sapiens
agaacttgtaggtggatacattgc

SEQ ID NO: 45145 - DNA, 24 bp, Homo sapiens
gagaacttgtaggtggatacattg

SEQ ID NO: 45146 - DNA, 24 bp, Homo sapiens
ggagaacttgtaggtggatacatt

SEQ ID NO: 45147 - DNA, 24 bp, Homo sapiens
gttaatgtaatccagaatacaaga

SEQ ID NO: 45148 - DNA, 24 bp, Homo sapiens
agttaatgtaatccagaatacaag

SEQ ID NO: 45149 - DNA, 24 bp, Homo sapiens
cagttaatgtaatccagaatacaa

SEQ ID NO: 45150 - DNA, 24 bp, Homo sapiens
gtcctgagtggggaattcaccaag

SEQ ID NO: 45151 - DNA, 24 bp, Homo sapiens
tgtcctgagtggggaattcaccaa

SEQ ID NO: 45152 - DNA, 24 bp, Homo sapiens
gtgtcctgagtggggaattcacca

SEQ ID NO: 45153 - DNA, 24 bp, Homo sapiens
gcgaacagcaaccatagcaacagc

SEQ ID NO: 45154 - DNA, 24 bp, Homo sapiens
gctcgtgccaataccaacaatgcc

SEQ ID NO: 45155 - DNA, 24 bp, Homo sapiens
agagacagagacgcctgctaccag

SEQ ID NO: 45156 - DNA, 24 bp, Homo sapiens
caagccctcatcagcgtcttccag

SEQ ID NO: 45157 - DNA, 24 bp, Homo sapiens
ctgctgctgctgctcttcctcttc

SEQ ID NO: 45158 - DNA, 24 bp, Homo sapiens
cggtatcctggagatcctgctggt

SEQ ID NO: 45159 - DNA, 23 bp, Homo sapiens
accgacgagcaggtcatcgagaa

SEQ ID NO: 45160 - DNA, 24 bp, Homo sapiens
tgtgggaggtgctgatgctctgta

SEQ ID NO: 45161 - DNA, 23 bp, Homo sapiens
aaatcgcagactttggcatgagc

SEQ ID NO: 45162 - DNA, 24 bp, Homo sapiens
gtgtattggctccttcggctgcgg

SEQ ID NO: 45163 - DNA, 24 bp, Homo sapiens
ccgctcactgcatggtagagtctg

SEQ ID NO: 45164 - DNA, 24 bp, Homo sapiens
ctctctcgctcccaccccttctta

SEQ ID NO: 45165 - DNA, 24 bp, Homo sapiens
agtattactggattgaagtagact

SEQ ID NO: 45166 - DNA, 24 bp, Homo sapiens
cagtattactggattgaagtagac

SEQ ID NO: 45167 - DNA, 24 bp, Homo sapiens
tcagtattactggattgaagtaga

SEQ ID NO: 45168 - DNA, 24 bp, Homo sapiens
aactgttccaggtaatttatttat

SEQ ID NO: 45169 - DNA, 24 bp, Homo sapiens
aaactgttccaggtaatttattta

SEQ ID NO: 45170 - DNA, 24 bp, Homo sapiens
gaaactgttccaggtaatttattt

SEQ ID NO: 45171 - DNA, 24 bp, Homo sapiens
agcaagttaagccctttgaatgtt

SEQ ID NO: 45172 - DNA, 24 bp, Homo sapiens
aagcaagttaagccctttgaatgt

SEQ ID NO: 45173 - DNA, 24 bp, Homo sapiens
aaagcaagttaagccctttgaatg

SEQ ID NO: 45174 - DNA, 24 bp, Homo sapiens
agggctacgaggtcacagatatga

SEQ ID NO: 45175 - DNA, 24 bp, Homo sapiens
aagggctacgaggtcacagatatg

SEQ ID NO: 45176 - DNA, 24 bp, Homo sapiens
gaagggctacgaggtcacagatat

SEQ ID NO: 45177 - DNA, 23 bp, Homo sapiens
actagccgtccatccgattccga

SEQ ID NO: 45178 - DNA, 23 bp, Homo sapiens
tggaggaggaccgggaggcagtg

SEQ ID NO: 45179 - DNA, 23 bp, Homo sapiens
gcaggcccaggcacagttggaaa

SEQ ID NO: 45180 - DNA, 24 bp, Homo sapiens
tttccaaaaagccaagcagaagca

SEQ ID NO: 45181 - DNA, 24 bp, Homo sapiens
ttttccaaaaagccaagcagaagc

SEQ ID NO: 45182 - DNA, 24 bp, Homo sapiens
cttttccaaaaagccaagcagaag

SEQ ID NO: 45183 - DNA, 24 bp, Homo sapiens
gactcctccagccccgccgtggcc

SEQ ID NO: 45184 - DNA, 24 bp, Homo sapiens
cgactcctccagccccgccgtggc

SEQ ID NO: 45185 - DNA, 24 bp, Homo sapiens
ccgactcctccagccccgccgtgg

SEQ ID NO: 45186 - DNA, 24 bp, Homo sapiens
cacatcaacagaaacagaagcaaa

SEQ ID NO: 45187 - DNA, 24 bp, Homo sapiens
ccacatcaacagaaacagaagcaa

SEQ ID NO: 45188 - DNA, 24 bp, Homo sapiens
cccacatcaacagaaacagaagca

SEQ ID NO: 45189 - DNA, 24 bp, Homo sapiens
gtggaaggacctgctcggctggaa

SEQ ID NO: 45190 - DNA, 24 bp, Homo sapiens
ctgttcctcaccatccctttcgcc

SEQ ID NO: 45191 - DNA, 24 bp, Homo sapiens
ggtgtgtcgggcaggaggtgatat

SEQ ID NO: 45192 - DNA, 24 bp, Homo sapiens
accaagttgggagagattctgagg

SEQ ID NO: 45193 - DNA, 24 bp, Homo sapiens
gaccaagttgggagagattctgag

SEQ ID NO: 45194 - DNA, 24 bp, Homo sapiens
tgaccaagttgggagagattctga

SEQ ID NO: 45195 - DNA, 24 bp, Homo sapiens
gcctactccccgacttcttgctgg

SEQ ID NO: 45196 - DNA, 24 bp, Homo sapiens
ttgagagcctgcgcctggccctag

SEQ ID NO: 45197 - DNA, 24 bp, Homo sapiens
atctcggctcgctacaacctccac

SEQ ID NO: 45198 - DNA, 24 bp, Homo sapiens
taggaagtaaggagcgtctctgcc

SEQ ID NO: 45199 - DNA, 24 bp, Homo sapiens
ggaagtgaggagcgtctctgcctg

SEQ ID NO: 45200 - DNA, 24 bp, Homo sapiens
tattattgaagcaaattcttgaaa

SEQ ID NO: 45201 - DNA, 24 bp, Homo sapiens
atattattgaagcaaattcttgaa

SEQ ID NO: 45202 - DNA, 24 bp, Homo sapiens
catattattgaagcaaattcttga

SEQ ID NO: 45203 - DNA, 23 bp, Homo sapiens
ggcgacagcagcaggagcgtcat

SEQ ID NO: 45204 - DNA, 25 bp, Homo sapiens
gctgctaatctgtcaacctgtcttg

SEQ ID NO: 45205 - DNA, 23 bp, Homo sapiens
cgcacacgctgatttgaaccctg

SEQ ID NO: 45206 - DNA, 25 bp, Homo sapiens
gctgaccaattctgcgtgaacactg

SEQ ID NO: 45207 - DNA, 25 bp, Homo sapiens
ctatgagtgccgagactgtgccaag

SEQ ID NO: 45208 - DNA, 24 bp, Homo sapiens
gccaggtcgctgtaagaagtgtag

SEQ ID NO: 45209 - DNA, 23 bp, Homo sapiens
cctgaacgaccatggcatcggcc

SEQ ID NO: 45210 - DNA, 23 bp, Homo sapiens
gtggcctcagcgagggatgcgga

SEQ ID NO: 45211 - DNA, 23 bp, Homo sapiens
cgcagagagccccagccacgccg

SEQ ID NO: 45212 - DNA, 25 bp, Homo sapiens
tcacatctctgccctcaaacatcgc

SEQ ID NO: 45213 - DNA, 23 bp, Homo sapiens
ccctaccttgccgcagtccctgg

SEQ ID NO: 45214 - DNA, 23 bp, Homo sapiens
tccggagaacgtggctcctcctc

SEQ ID NO: 45215 - DNA, 24 bp, Homo sapiens
ccagcacaaaggtgagagggctgg

SEQ ID NO: 45216 - DNA, 24 bp, Homo sapiens
cccagcacaaaggtgagagggctg

SEQ ID NO: 45217 - DNA, 24 bp, Homo sapiens
tcccagcacaaaggtgagagggct

SEQ ID NO: 45218 - DNA, 24 bp, Homo sapiens
ctgagaccaaggtaggcattcaga

SEQ ID NO: 45219 - DNA, 24 bp, Homo sapiens
cctgagaccaaggtaggcattcag

SEQ ID NO: 45220 - DNA, 24 bp, Homo sapiens
acctgagaccaaggtaggcattca

SEQ ID NO: 45221 - DNA, 23 bp, Homo sapiens
tgcggctggctgacaacttcatc

SEQ ID NO: 45222 - DNA, 24 bp, Homo sapiens
acactgtctcgcaatgccatcacc

SEQ ID NO: 45223 - DNA, 23 bp, Homo sapiens
cttgacggcaacaggctggtgga

SEQ ID NO: 45224 - DNA, 24 bp, Homo sapiens
tgaagcacggacgcacagtacatt

SEQ ID NO: 45225 - DNA, 24 bp, Homo sapiens
caatggcatgacgatcacgatggt

SEQ ID NO: 45226 - DNA, 24 bp, Homo sapiens
cctgctggacatcttcaccatccg

SEQ ID NO: 45227 - DNA, 25 bp, Homo sapiens
aggtcccggatgctgcaattcttac

SEQ ID NO: 45228 - DNA, 23 bp, Homo sapiens
atgcttggttcccgaatcggatc

SEQ ID NO: 45229 - DNA, 23 bp, Homo sapiens
ttcgctggatcccctgatccgct

SEQ ID NO: 45230 - DNA, 25 bp, Homo sapiens
tgctggtagagggaaaggaagaggg

SEQ ID NO: 45231 - DNA, 23 bp, Homo sapiens
taggtcttcggctgctgctgctg

SEQ ID NO: 45232 - DNA, 23 bp, Homo sapiens
tgtccaaggtcaggtgcccatct

SEQ ID NO: 45233 - DNA, 24 bp, Homo sapiens
tttggatgcagagatcgttaagga

SEQ ID NO: 45234 - DNA, 24 bp, Homo sapiens
ctttggatgcagagatcgttaagg

SEQ ID NO: 45235 - DNA, 24 bp, Homo sapiens
tctttggatgcagagatcgttaag

SEQ ID NO: 45236 - DNA, 23 bp, Homo sapiens
ccgccgtcgcccgtgcccctccc

SEQ ID NO: 45237 - DNA, 23 bp, Homo sapiens
gagtcgctgccgcagctgttggg

SEQ ID NO: 45238 - DNA, 23 bp, Homo sapiens
caccggccgcatggagcccccgg

SEQ ID NO: 45239 - DNA, 24 bp, Homo sapiens
cgtggtggaagagccctgcacaat

SEQ ID NO: 45240 - DNA, 24 bp, Homo sapiens
acgtggtggaagagccctgcacaa

SEQ ID NO: 45241 - DNA, 24 bp, Homo sapiens
cacgtggtggaagagccctgcaca

SEQ ID NO: 45242 - DNA, 24 bp, Homo sapiens
agttaaaacagagcattgagtggc

SEQ ID NO: 45243 - DNA, 24 bp, Homo sapiens
aagttaaaacagagcattgagtgg

SEQ ID NO: 45244 - DNA, 24 bp, Homo sapiens
gaagttaaaacagagcattgagtg

SEQ ID NO: 45245 - DNA, 24 bp, Homo sapiens
aacttgtactggaagaacatactt

SEQ ID NO: 45246 - DNA, 24 bp, Homo sapiens
aaacttgtactggaagaacatact

SEQ ID NO: 45247 - DNA, 24 bp, Homo sapiens
aaaacttgtactggaagaacatac

SEQ ID NO: 45248 - DNA, 24 bp, Homo sapiens
atctgaaaaagagtcaagaaaaat

SEQ ID NO: 45249 - DNA, 24 bp, Homo sapiens
aatctgaaaaagagtcaagaaaaa

SEQ ID NO: 45250 - DNA, 24 bp, Homo sapiens
taatctgaaaaagagtcaagaaaa

SEQ ID NO: 45251 - DNA, 23 bp, Homo sapiens
gctgctgctgatgcccgaagagg

SEQ ID NO: 45252 - DNA, 23 bp, Homo sapiens
cgtccagactctcggcaccacag

SEQ ID NO: 45253 - DNA, 25 bp, Homo sapiens
ggaggtcctggagaagattacggag

SEQ ID NO: 45254 - DNA, 23 bp, Homo sapiens
cgcttcccgctcaatggctactg

SEQ ID NO: 45255 - DNA, 23 bp, Homo sapiens
gcctgtgactgcctggtggtgcg

SEQ ID NO: 45256 - DNA, 23 bp, Homo sapiens
ctggcagcaggagcaggagcagc

SEQ ID NO: 45257 - DNA, 23 bp, Homo sapiens
caacaggcgaggcaggacagagg

SEQ ID NO: 45258 - DNA, 23 bp, Homo sapiens
ctgaccttggagtcgcaggcacc

SEQ ID NO: 45259 - DNA, 24 bp, Homo sapiens
cgggttagggtggaatgggctttg

SEQ ID NO: 45260 - DNA, 24 bp, Homo sapiens
tttcaatgtaggtgctgtaaatgc

SEQ ID NO: 45261 - DNA, 24 bp, Homo sapiens
gtttcaatgtaggtgctgtaaatg

SEQ ID NO: 45262 - DNA, 24 bp, Homo sapiens
tgtttcaatgtaggtgctgtaaat

SEQ ID NO: 45263 - DNA, 24 bp, Homo sapiens
cattattcaaggtttcaaaaatga

SEQ ID NO: 45264 - DNA, 24 bp, Homo sapiens
tcattattcaaggtttcaaaaatg

SEQ ID NO: 45265 - DNA, 24 bp, Homo sapiens
ctcattattcaaggtttcaaaaat

SEQ ID NO: 45266 - DNA, 24 bp, Homo sapiens
ccacagatcagcccgtggaccggg

SEQ ID NO: 45267 - DNA, 24 bp, Homo sapiens
tccacagatcagcccgtggaccgg

SEQ ID NO: 45268 - DNA, 24 bp, Homo sapiens
ttccacagatcagcccgtggaccg

SEQ ID NO: 45269 - DNA, 23 bp, Homo sapiens
gagacttcgtgaggagccacctg

SEQ ID NO: 45270 - DNA, 23 bp, Homo sapiens
ggtggctctgagggtcctgttcc

SEQ ID NO: 45271 - DNA, 23 bp, Homo sapiens
ccagcaggagcaggagcaggagc

SEQ ID NO: 45272 - DNA, 23 bp, Homo sapiens
cctgcacctaagtctgagccagc

SEQ ID NO: 45273 - DNA, 23 bp, Homo sapiens
ccgtgaagaggagcctgggcaag

SEQ ID NO: 45274 - DNA, 23 bp, Homo sapiens
cactccgccagccacaggaccac

SEQ ID NO: 45275 - DNA, 24 bp, Homo sapiens
tcttctctcgagtttataatctgc

SEQ ID NO: 45276 - DNA, 24 bp, Homo sapiens
ttcttctctcgagtttataatctg

SEQ ID NO: 45277 - DNA, 24 bp, Homo sapiens
cttcttctctcgagtttataatct

SEQ ID NO: 45278 - DNA, 23 bp, Homo sapiens
caaggagcaggttcagcgggatg

SEQ ID NO: 45279 - DNA, 23 bp, Homo sapiens
acttcaccgtggaggtcgttggt

SEQ ID NO: 45280 - DNA, 24 bp, Homo sapiens
cctcatcctcatcttctgcctgcg

SEQ ID NO: 45281 - DNA, 24 bp, Homo sapiens
tttcatgcttgatgatctcaatgc

SEQ ID NO: 45282 - DNA, 24 bp, Homo sapiens
atttcatgcttgatgatctcaatg

SEQ ID NO: 45283 - DNA, 24 bp, Homo sapiens
tatttcatgcttgatgatctcaat

SEQ ID NO: 45284 - DNA, 24 bp, Homo sapiens
tattttaaaaggtaatttggaata

SEQ ID NO: 45285 - DNA, 24 bp, Homo sapiens
atattttaaaaggtaatttggaat

SEQ ID NO: 45286 - DNA, 24 bp, Homo sapiens
tatattttaaaaggtaatttggaa

SEQ ID NO: 45287 - DNA, 24 bp, Homo sapiens
acgatgaagaggccaaaaagatag

SEQ ID NO: 45288 - DNA, 24 bp, Homo sapiens
cacgatgaagaggccaaaaagata

SEQ ID NO: 45289 - DNA, 24 bp, Homo sapiens
tcacgatgaagaggccaaaaagat

SEQ ID NO: 45290 - DNA, 23 bp, Homo sapiens
aagatggctgctgctttgtaggc

SEQ ID NO: 45291 - DNA, 25 bp, Homo sapiens
agtgttctgtggctgctttgtgtca

SEQ ID NO: 45292 - DNA, 24 bp, Homo sapiens
gaccctgaaagaggagggaggacc

SEQ ID NO: 45293 - DNA, 25 bp, Homo sapiens
aacgggacaggacagagagacagag

SEQ ID NO: 45294 - DNA, 23 bp, Homo sapiens
tttccctccaccacagccatcct

SEQ ID NO: 45295 - DNA, 24 bp, Homo sapiens
ttccactatacacagtcaccgtcc

SEQ ID NO: 45296 - DNA, 23 bp, Homo sapiens
gcggctcctgagttcctaatgct

SEQ ID NO: 45297 - DNA, 25 bp, Homo sapiens
ggtaaggaactcagccaatagccat

SEQ ID NO: 45298 - DNA, 23 bp, Homo sapiens
cctcctgcctcagcctccagaat

SEQ ID NO: 45299 - DNA, 25 bp, Homo sapiens
gctacgcttcatcatctatgccttc

SEQ ID NO: 45300 - DNA, 23 bp, Homo sapiens
ttggtagacagaaggacgcacgc

SEQ ID NO: 45301 - DNA, 24 bp, Homo sapiens
ccgctgctgtggtacttctactca

SEQ ID NO: 45302 - DNA, 24 bp, Homo sapiens
agattgtgatggttgattacgaag

SEQ ID NO: 45303 - DNA, 24 bp, Homo sapiens
cagattgtgatggttgattacgaa

SEQ ID NO: 45304 - DNA, 24 bp, Homo sapiens
ccagattgtgatggttgattacga

SEQ ID NO: 45305 - DNA, 25 bp, Homo sapiens
accgcctgaaggaggagaatgagaa

SEQ ID NO: 45306 - DNA, 23 bp, Homo sapiens
tgaggacagccagcgaccaggag

SEQ ID NO: 45307 - DNA, 23 bp, Homo sapiens
gctgtatctactgaagcaggagc

SEQ ID NO: 45308 - DNA, 25 bp, Homo sapiens
gccttctggagatgcttccgaactg

SEQ ID NO: 45309 - DNA, 25 bp, Homo sapiens
ttactgtgtcctgatttcccgctgg

SEQ ID NO: 45310 - DNA, 24 bp, Homo sapiens
aggattgtgctcatggacgatgcc

SEQ ID NO: 45311 - DNA, 25 bp, Homo sapiens
agtgccagtgtcatccagttagagg

SEQ ID NO: 45312 - DNA, 23 bp, Homo sapiens
gtgctgggattacaggcgtgacc

SEQ ID NO: 45313 - DNA, 23 bp, Homo sapiens
gggaagcactcagaggaactggc

SEQ ID NO: 45314 - DNA, 24 bp, Homo sapiens
cataatttcagaaaactgtttaaa

SEQ ID NO: 45315 - DNA, 24 bp, Homo sapiens
tcataatttcagaaaactgtttaa

SEQ ID NO: 45316 - DNA, 24 bp, Homo sapiens
ttcataatttcagaaaactgttta

SEQ ID NO: 45317 - DNA, 23 bp, Homo sapiens
atggcggcaggagcagatagggt

SEQ ID NO: 45318 - DNA, 23 bp, Homo sapiens
cgctgccttaagaagctgagact

SEQ ID NO: 45319 - DNA, 23 bp, Homo sapiens
cgtggactgcctcaggccgagtg

SEQ ID NO: 45320 - DNA, 24 bp, Homo sapiens
attgttaacctgcaaaattccact

SEQ ID NO: 45321 - DNA, 24 bp, Homo sapiens
cattgttaacctgcaaaattccac

SEQ ID NO: 45322 - DNA, 24 bp, Homo sapiens
tcattgttaacctgcaaaattcca

SEQ ID NO: 45323 - DNA, 24 bp, Homo sapiens
ggagctcactgtcttctccctgat

SEQ ID NO: 45324 - DNA, 24 bp, Homo sapiens
tggagctcactgtcttctccctga

SEQ ID NO: 45325 - DNA, 24 bp, Homo sapiens
gtggagctcactgtcttctccctg

SEQ ID NO: 45326 - DNA, 24 bp, Homo sapiens
gagtgaggctgcggctttggctgg

SEQ ID NO: 45327 - DNA, 24 bp, Homo sapiens
tgagtgaggctgcggctttggctg

SEQ ID NO: 45328 - DNA, 24 bp, Homo sapiens
ctgagtgaggctgcggctttggct

SEQ ID NO: 45329 - DNA, 24 bp, Homo sapiens
aatgtggtggtgcgttatgggctc

SEQ ID NO: 45330 - DNA, 25 bp, Homo sapiens
gaccagcaagaagtgatccagaagt

SEQ ID NO: 45331 - DNA, 23 bp, Homo sapiens
aacagcagccagagcacccacat

SEQ ID NO: 45332 - DNA, 23 bp, Homo sapiens
ccaccacacgcacaaggacaccg

SEQ ID NO: 45333 - DNA, 25 bp, Homo sapiens
gaacttaaactccagagggcacagc

SEQ ID NO: 45334 - DNA, 23 bp, Homo sapiens
caggagcacagccaacagccttg

SEQ ID NO: 45335 - DNA, 24 bp, Homo sapiens
atttattacagattcattatattt

SEQ ID NO: 45336 - DNA, 24 bp, Homo sapiens
tatttattacagattcattatatt

SEQ ID NO: 45337 - DNA, 24 bp, Homo sapiens
gtatttattacagattcattatat

SEQ ID NO: 45338 - DNA, 24 bp, Homo sapiens
tgacgtttcagcatcatccccaga

SEQ ID NO: 45339 - DNA, 24 bp, Homo sapiens
ctgacgtttcagcatcatccccag

SEQ ID NO: 45340 - DNA, 24 bp, Homo sapiens
cctgacgtttcagcatcatcccca

SEQ ID NO: 45341 - DNA, 24 bp, Homo sapiens
taataataatggagcttttgatgg

SEQ ID NO: 45342 - DNA, 24 bp, Homo sapiens
ctaataataatggagcttttgatg

SEQ ID NO: 45343 - DNA, 24 bp, Homo sapiens
tctaataataatggagcttttgat

SEQ ID NO: 45344 - DNA, 24 bp, Homo sapiens
gtaactgggtgatccacctccgac

SEQ ID NO: 45345 - DNA, 24 bp, Homo sapiens
agtaactgggtgatccacctccga

SEQ ID NO: 45346 - DNA, 24 bp, Homo sapiens
tagtaactgggtgatccacctccg

SEQ ID NO: 45347 - DNA, 25 bp, Homo sapiens
ttgttgctgctgctgttgttgttgt

SEQ ID NO: 45348 - DNA, 25 bp, Homo sapiens
tgagacgcaggaagattaagcactt

SEQ ID NO: 45349 - DNA, 23 bp, Homo sapiens
gcagtggcacagtcttggctcac

SEQ ID NO: 45350 - DNA, 24 bp, Homo sapiens
catttttaaagggagccatttctg

SEQ ID NO: 45351 - DNA, 24 bp, Homo sapiens
acatttttaaagggagccatttct

SEQ ID NO: 45352 - DNA, 24 bp, Homo sapiens
tacatttttaaagggagccatttc

SEQ ID NO: 45353 - DNA, 24 bp, Homo sapiens
cggcgcagaaggtctcttcccgga

SEQ ID NO: 45354 - DNA, 24 bp, Homo sapiens
ccggcgcagaaggtctcttcccgg

SEQ ID NO: 45355 - DNA, 24 bp, Homo sapiens
gccggcgcagaaggtctcttcccg

SEQ ID NO: 45356 - DNA, 25 bp, Homo sapiens
ttgaggcaggagaattgcttgaacc

SEQ ID NO: 45357 - DNA, 25 bp, Homo sapiens
aaagaaatgtgacaatgaaataaat

SEQ ID NO: 45358 - DNA, 23 bp, Homo sapiens
cactgcactccagctccaaaaaa

SEQ ID NO: 45359 - DNA, 24 bp, Homo sapiens
catttttccagaaaagtcttttaa

SEQ ID NO: 45360 - DNA, 24 bp, Homo sapiens
gcatttttccagaaaagtctttta

SEQ ID NO: 45361 - DNA, 24 bp, Homo sapiens
tgcatttttccagaaaagtctttt

SEQ ID NO: 45362 - DNA, 24 bp, Homo sapiens
aagtcaaactgttgcagttgtatt

SEQ ID NO: 45363 - DNA, 24 bp, Homo sapiens
aaagtcaaactgttgcagttgtat

SEQ ID NO: 45364 - DNA, 24 bp, Homo sapiens
taaagtcaaactgttgcagttgta

SEQ ID NO: 45365 - DNA, 24 bp, Homo sapiens
aacaaatataggaagtttgtttgc

SEQ ID NO: 45366 - DNA, 24 bp, Homo sapiens
aaacaaatataggaagtttgtttg

SEQ ID NO: 45367 - DNA, 24 bp, Homo sapiens
aaaacaaatataggaagtttgttt

SEQ ID NO: 45368 - DNA, 24 bp, Homo sapiens
tctgccctcaggggtgtctaggaa

SEQ ID NO: 45369 - DNA, 24 bp, Homo sapiens
ttctgccctcaggggtgtctagga

SEQ ID NO: 45370 - DNA, 24 bp, Homo sapiens
attctgccctcaggggtgtctagg

SEQ ID NO: 45371 - DNA, 23 bp, Homo sapiens
tgtctgtgttcacgcatcaccgc

SEQ ID NO: 45372 - DNA, 24 bp, Homo sapiens
ctacaagaacgtgaagaagcagcc

SEQ ID NO: 45373 - DNA, 23 bp, Homo sapiens
gcgaggaggaactggcagccgtg

SEQ ID NO: 45374 - DNA, 24 bp, Homo sapiens
tcttttattagcaaggacattgga

SEQ ID NO: 45375 - DNA, 24 bp, Homo sapiens
ttcttttattagcaaggacattgg

SEQ ID NO: 45376 - DNA, 24 bp, Homo sapiens
tttcttttattagcaaggacattg

SEQ ID NO: 45377 - DNA, 23 bp, Homo sapiens
ccgccttgctgtctgtctcttgg

SEQ ID NO: 45378 - DNA, 23 bp, Homo sapiens
cggaacacgcacacccagccagg

SEQ ID NO: 45379 - DNA, 23 bp, Homo sapiens
gtggcgtgggccacgcatggatc

SEQ ID NO: 45380 - DNA, 23 bp, Homo sapiens
tgaccaacagagactgcggcgag

SEQ ID NO: 45381 - DNA, 23 bp, Homo sapiens
gtgggctgggtgctggacgaggg

SEQ ID NO: 45382 - DNA, 23 bp, Homo sapiens
ctggagatgtggctgctgtgctg

SEQ ID NO: 45383 - DNA, 24 bp, Homo sapiens
ggtggacttggatacagccgactt

SEQ ID NO: 45384 - DNA, 23 bp, Homo sapiens
tgtgactaagcggagtgcctgga

SEQ ID NO: 45385 - DNA, 24 bp, Homo sapiens
cagaggcagagaggttggctgaac

SEQ ID NO: 45386 - DNA, 24 bp, Homo sapiens
acagaggcagagaggttggctgaa

SEQ ID NO: 45387 - DNA, 24 bp, Homo sapiens
aacagaggcagagaggttggctga

SEQ ID NO: 45388 - DNA, 24 bp, Homo sapiens
catcatctacgcctggtccatcgg

SEQ ID NO: 45389 - DNA, 24 bp, Homo sapiens
tgtcctacccagatgttagtgcca

SEQ ID NO: 45390 - DNA, 24 bp, Homo sapiens
gaccaggaccgtgaggcagcatct

SEQ ID NO: 45391 - DNA, 24 bp, Homo sapiens
gaccaggaccgtgaggcagcatct

SEQ ID NO: 45392 - DNA, 24 bp, Homo sapiens
cctttgatgacctggtgcccttgg

SEQ ID NO: 45393 - DNA, 24 bp, Homo sapiens
tgtcctacccagatgttagtgcca

SEQ ID NO: 45394 - DNA, 24 bp, Homo sapiens
tttttatttagacgaaaaaagtat

SEQ ID NO: 45395 - DNA, 24 bp, Homo sapiens
ctttttatttagacgaaaaaagta

SEQ ID NO: 45396 - DNA, 24 bp, Homo sapiens
cctttttatttagacgaaaaaagt

SEQ ID NO: 45397 - DNA, 24 bp, Homo sapiens
aaaccagattgcttattctttgtc

SEQ ID NO: 45398 - DNA, 24 bp, Homo sapiens
gaaaccagattgcttattctttgt

SEQ ID NO: 45399 - DNA, 24 bp, Homo sapiens
cgaaaccagattgcttattctttg

SEQ ID NO: 45400 - DNA, 23 bp, Homo sapiens
ctgctgctgctgctgctgctggt

SEQ ID NO: 45401 - DNA, 23 bp, Homo sapiens
cctgctgatggggaagtccgaag

SEQ ID NO: 45402 - DNA, 23 bp, Homo sapiens
tgccctggtggccttgggtgtcc

SEQ ID NO: 45403 - DNA, 24 bp, Homo sapiens
taccattgagtaagaaatgactgg

SEQ ID NO: 45404 - DNA, 24 bp, Homo sapiens
ttaccattgagtaagaaatgactg

SEQ ID NO: 45405 - DNA, 24 bp, Homo sapiens
tttaccattgagtaagaaatgact

SEQ ID NO: 45406 - DNA, 24 bp, Homo sapiens
gtagcagcagcacaaccagccaag

SEQ ID NO: 45407 - DNA, 24 bp, Homo sapiens
gacacagccacagcaacagagcag

SEQ ID NO: 45408 - DNA, 24 bp, Homo sapiens
caggagccatcagtgccatcaagg

SEQ ID NO: 45409 - DNA, 23 bp, Homo sapiens
aggctgtgctggctggtctcgta

SEQ ID NO: 45410 - DNA, 23 bp, Homo sapiens
catcaagtcacagcctggtcacg

SEQ ID NO: 45411 - DNA, 23 bp, Homo sapiens
gcctagccgtcaccgtctcttct

SEQ ID NO: 45412 - DNA, 23 bp, Homo sapiens
ggtgctgtggctgtcatctgaac

SEQ ID NO: 45413 - DNA, 25 bp, Homo sapiens
atgttaagtcctgttgagagcacca

SEQ ID NO: 45414 - DNA, 25 bp, Homo sapiens
tgtgattcctggcggttatagaggc

SEQ ID NO: 45415 - DNA, 24 bp, Homo sapiens
tggaaagaaaggaaaaagaatggg

SEQ ID NO: 45416 - DNA, 24 bp, Homo sapiens
ttggaaagaaaggaaaaagaatgg

SEQ ID NO: 45417 - DNA, 24 bp, Homo sapiens
gttggaaagaaaggaaaaagaatg

SEQ ID NO: 45418 - DNA, 25 bp, Homo sapiens
tggaattggtgggttcttggtctca

SEQ ID NO: 45419 - DNA, 25 bp, Homo sapiens
ggcttatccgaggtctcaatccatt

SEQ ID NO: 45420 - DNA, 24 bp, Homo sapiens
gtgctacggacgacgcctatgaag

SEQ ID NO: 45421 - DNA, 23 bp, Homo sapiens
gctgctggtgcctggaatcttgt

SEQ ID NO: 45422 - DNA, 24 bp, Homo sapiens
gtcctacctcctcgtgtggcttct

SEQ ID NO: 45423 - DNA, 23 bp, Homo sapiens
ctgctgctgctgctcctcctcat

SEQ ID NO: 45424 - DNA, 24 bp, Homo sapiens
ggaattggtgggttcttggtctca

SEQ ID NO: 45425 - DNA, 23 bp, Homo sapiens
ccaggctggtatgcagtcatgtt

SEQ ID NO: 45426 - DNA, 24 bp, Homo sapiens
gtcctacctcctcgtgtggcttct

SEQ ID NO: 45427 - DNA, 23 bp, Homo sapiens
gctgctggtgcctggaatcttgt

SEQ ID NO: 45428 - DNA, 25 bp, Homo sapiens
gtcactcatctcctcatcaagcggc

SEQ ID NO: 45429 - DNA, 23 bp, Homo sapiens
caccattgctcgctatgagtggc

SEQ ID NO: 45430 - DNA, 25 bp, Homo sapiens
gtcactcatctcctcatcaagcggc

SEQ ID NO: 45431 - DNA, 23 bp, Homo sapiens
gctgctggtgcctggaatcttgt

SEQ ID NO: 45432 - DNA, 24 bp, Homo sapiens
cttctcgacggtgacggctgtctc

SEQ ID NO: 45433 - DNA, 24 bp, Homo sapiens
ctgctgctgctcctggggctgctg

SEQ ID NO: 45434 - DNA, 24 bp, Homo sapiens
gacggtgcggggcgctggggcagg

SEQ ID NO: 45435 - DNA, 24 bp, Homo sapiens
gtctcggtgctgctgctgctgctc

SEQ ID NO: 45436 - DNA, 24 bp, Homo sapiens
gatcgcaggtagagcaggacgctg

SEQ ID NO: 45437 - DNA, 24 bp, Homo sapiens
aggctttgggtccacgcacaggat

SEQ ID NO: 45438 - DNA, 23 bp, Homo sapiens
gctcggaaacggggtctctgggg

SEQ ID NO: 45439 - DNA, 23 bp, Homo sapiens
ctgttccgctgcaggttggcccc

SEQ ID NO: 45440 - DNA, 23 bp, Homo sapiens
cgtgtcccgccgtgcccgtcgcg

SEQ ID NO: 45441 - DNA, 24 bp, Homo sapiens
cagcagcagcagcagcagcaacag

SEQ ID NO: 45442 - DNA, 24 bp, Homo sapiens
gtccacttccagtcgccaccacct

SEQ ID NO: 45443 - DNA, 24 bp, Homo sapiens
cagcagtcgcagcatcagaaggtg

SEQ ID NO: 45444 - DNA, 24 bp, Homo sapiens
ggccccctccgtccctgcctctgg

SEQ ID NO: 45445 - DNA, 24 bp, Homo sapiens
tggccccctccgtccctgcctctg

SEQ ID NO: 45446 - DNA, 24 bp, Homo sapiens
gtggccccctccgtccctgcctct

SEQ ID NO: 45447 - DNA, 24 bp, Homo sapiens
atcagtatgaggtatgagaatgtg

SEQ ID NO: 45448 - DNA, 24 bp, Homo sapiens
gatcagtatgaggtatgagaatgt

SEQ ID NO: 45449 - DNA, 24 bp, Homo sapiens
cgatcagtatgaggtatgagaatg

SEQ ID NO: 45450 - DNA, 24 bp, Homo sapiens
agtcatcctgggcatctttggcac

SEQ ID NO: 45451 - DNA, 23 bp, Homo sapiens
ggtgctctgggttggctggaatg

SEQ ID NO: 45452 - DNA, 25 bp, Homo sapiens
tctgcttctacttggaggttggaca

SEQ ID NO: 45453 - DNA, 24 bp, Homo sapiens
aatattagcagagatgcaattgag

SEQ ID NO: 45454 - DNA, 24 bp, Homo sapiens
gaatattagcagagatgcaattga

SEQ ID NO: 45455 - DNA, 24 bp, Homo sapiens
agaatattagcagagatgcaattg

SEQ ID NO: 45456 - DNA, 25 bp, Homo sapiens
tgaagatttgcataaagccaacatt

SEQ ID NO: 45457 - DNA, 25 bp, Homo sapiens
aacaaattaaagcaagaaccccctg

SEQ ID NO: 45458 - DNA, 25 bp, Homo sapiens
catggattttatgggattaattata

SEQ ID NO: 45459 - DNA, 23 bp, Homo sapiens
acgcagtgcagtcatccatcagc

SEQ ID NO: 45460 - DNA, 25 bp, Homo sapiens
gaccttgttcctaagttgatgttgc

SEQ ID NO: 45461 - DNA, 23 bp, Homo sapiens
tgttgggatgtgtggtgatggcg

SEQ ID NO: 45462 - DNA, 25 bp, Homo sapiens
gaccttgttcctaagttgatgttgc

SEQ ID NO: 45463 - DNA, 23 bp, Homo sapiens
tgttgggatgtgtggtgatggcg

SEQ ID NO: 45464 - DNA, 23 bp, Homo sapiens
gaagagggcacacggaggcattt

SEQ ID NO: 45465 - DNA, 23 bp, Homo sapiens
gaagagggcacacggaggcattt

SEQ ID NO: 45466 - DNA, 23 bp, Homo sapiens
tgttgggatgtgtggtgatggcg

SEQ ID NO: 45467 - DNA, 25 bp, Homo sapiens
cagaagacacagttgatagaagcat

SEQ ID NO: 45468 - DNA, 24 bp, Homo sapiens
ggtggtggctggtgaagaatgagg

SEQ ID NO: 45469 - DNA, 24 bp, Homo sapiens
ctgaagaggtcacagactggctgc

SEQ ID NO: 45470 - DNA, 24 bp, Homo sapiens
gaacttctccactgccacggtgag

SEQ ID NO: 45471 - DNA, 24 bp, Homo sapiens
ggtggtggctggtgaagaatgagg

SEQ ID NO: 45472 - DNA, 24 bp, Homo sapiens
ggagcggctacattccaagcaaca

SEQ ID NO: 45473 - DNA, 24 bp, Homo sapiens
ctgaagaggtcacagactggctgc

SEQ ID NO: 45474 - DNA, 23 bp, Homo sapiens
ctgcggtcaatgggatctgggtg

SEQ ID NO: 45475 - DNA, 23 bp, Homo sapiens
ctggtggctctcttcggcatggg

SEQ ID NO: 45476 - DNA, 23 bp, Homo sapiens
tgtgacctttgccctgacctgga

SEQ ID NO: 45477 - DNA, 23 bp, Homo sapiens
ccgtctggagccgagatggagcc

SEQ ID NO: 45478 - DNA, 23 bp, Homo sapiens
ctctgacggcattctggtgagcg

SEQ ID NO: 45479 - DNA, 23 bp, Homo sapiens
aggctcggctgacaggacggtaa

SEQ ID NO: 45480 - DNA, 24 bp, Homo sapiens
cagaggagcaggtgctggaggtgg

SEQ ID NO: 45481 - DNA, 24 bp, Homo sapiens
tcagaggagcaggtgctggaggtg

SEQ ID NO: 45482 - DNA, 24 bp, Homo sapiens
gtcagaggagcaggtgctggaggt

SEQ ID NO: 45483 - DNA, 24 bp, Homo sapiens
agaaattataggaggaacaagtga

SEQ ID NO: 45484 - DNA, 24 bp, Homo sapiens
aagaaattataggaggaacaagtg

SEQ ID NO: 45485 - DNA, 24 bp, Homo sapiens
aaagaaattataggaggaacaagt

SEQ ID NO: 45486 - DNA, 25 bp, Homo sapiens
cgaggcgagaggatcacttgaggta

SEQ ID NO: 45487 - DNA, 25 bp, Homo sapiens
tgttcagtccatcgtcattcagtct

SEQ ID NO: 45488 - DNA, 24 bp, Homo sapiens
gactctcgtcaacgctggacactt

SEQ ID NO: 45489 - DNA, 24 bp, Homo sapiens
atcataaaaaaagctctgaggaac

SEQ ID NO: 45490 - DNA, 24 bp, Homo sapiens
catcataaaaaaagctctgaggaa

SEQ ID NO: 45491 - DNA, 24 bp, Homo sapiens
ccatcataaaaaaagctctgagga

SEQ ID NO: 45492 - DNA, 23 bp, Homo sapiens
cctcccctcagcggtggctccca

SEQ ID NO: 45493 - DNA, 23 bp, Homo sapiens
ccccctccctcctccgttccccc

SEQ ID NO: 45494 - DNA, 23 bp, Homo sapiens
gcggcagcggcggcggctacacc

SEQ ID NO: 45495 - DNA, 24 bp, Homo sapiens
ctgaagtcatggtgagtggggctg

SEQ ID NO: 45496 - DNA, 24 bp, Homo sapiens
actgaagtcatggtgagtggggct

SEQ ID NO: 45497 - DNA, 24 bp, Homo sapiens
cactgaagtcatggtgagtggggc

SEQ ID NO: 45498 - DNA, 24 bp, Homo sapiens
agaaaaaatcggtaaataacattc

SEQ ID NO: 45499 - DNA, 24 bp, Homo sapiens
aagaaaaaatcggtaaataacatt

SEQ ID NO: 45500 - DNA, 24 bp, Homo sapiens
aaagaaaaaatcggtaaataacat

SEQ ID NO: 45501 - DNA, 24 bp, Homo sapiens
attgagaaaagataacttctacaa

SEQ ID NO: 45502 - DNA, 24 bp, Homo sapiens
tattgagaaaagataacttctaca

SEQ ID NO: 45503 - DNA, 24 bp, Homo sapiens
gtattgagaaaagataacttctac

SEQ ID NO: 45504 - DNA, 24 bp, Homo sapiens
ttttagaaaaggtaataaatagtt

SEQ ID NO: 45505 - DNA, 24 bp, Homo sapiens
attttagaaaaggtaataaatagt

SEQ ID NO: 45506 - DNA, 24 bp, Homo sapiens
tattttagaaaaggtaataaatag

SEQ ID NO: 45507 - DNA, 24 bp, Homo sapiens
aaactcagcaagggaaatactgtt

SEQ ID NO: 45508 - DNA, 24 bp, Homo sapiens
caaactcagcaagggaaatactgt

SEQ ID NO: 45509 - DNA, 24 bp, Homo sapiens
acaaactcagcaagggaaatactg

SEQ ID NO: 45510 - DNA, 24 bp, Homo sapiens
tagcccatatgcatataggtaatc

SEQ ID NO: 45511 - DNA, 24 bp, Homo sapiens
ttagcccatatgcatataggtaat

SEQ ID NO: 45512 - DNA, 24 bp, Homo sapiens
tttagcccatatgcatataggtaa

SEQ ID NO: 45513 - DNA, 24 bp, Homo sapiens
aggagcaggtgcgggagcagctgg

SEQ ID NO: 45514 - DNA, 24 bp, Homo sapiens
aaggagcaggtgcgggagcagctg

SEQ ID NO: 45515 - DNA, 24 bp, Homo sapiens
gaaggagcaggtgcgggagcagct

SEQ ID NO: 45516 - DNA, 24 bp, Homo sapiens
taatgttgcagaaaataaagttat

SEQ ID NO: 45517 - DNA, 24 bp, Homo sapiens
ctaatgttgcagaaaataaagtta

SEQ ID NO: 45518 - DNA, 24 bp, Homo sapiens
tctaatgttgcagaaaataaagtt

SEQ ID NO: 45519 - DNA, 25 bp, Homo sapiens
gtcttgctctgtcgcttaggagtgc

SEQ ID NO: 45520 - DNA, 25 bp, Homo sapiens
tgtctagtccttctaacagccgtga

SEQ ID NO: 45521 - DNA, 25 bp, Homo sapiens
cagggtctctctttgttgtccaggt

SEQ ID NO: 45522 - DNA, 25 bp, Homo sapiens
agcagcagaagcagcagatcattaa

SEQ ID NO: 45523 - DNA, 25 bp, Homo sapiens
atatgccaccacaactccagaatct

SEQ ID NO: 45524 - DNA, 25 bp, Homo sapiens
accctgagttaccctatgacccaag

SEQ ID NO: 45525 - DNA, 24 bp, Homo sapiens
caactgaagagttaaaaaaaatgg

SEQ ID NO: 45526 - DNA, 24 bp, Homo sapiens
acaactgaagagttaaaaaaaatg

SEQ ID NO: 45527 - DNA, 24 bp, Homo sapiens
tacaactgaagagttaaaaaaaat

SEQ ID NO: 45528 - DNA, 25 bp, Homo sapiens
gctaggattacaggcatgagtcacc

SEQ ID NO: 45529 - DNA, 24 bp, Homo sapiens
ggtgcaatggtgcaatcatggctc

SEQ ID NO: 45530 - DNA, 23 bp, Homo sapiens
ggccaagatcacctaacaaaatt

SEQ ID NO: 45531 - DNA, 24 bp, Homo sapiens
ggctcaagtcatcctcctgcttca

SEQ ID NO: 45532 - DNA, 24 bp, Homo sapiens
gcagcggcataatcatggctcact

SEQ ID NO: 45533 - DNA, 25 bp, Homo sapiens
gcttggaagatttggttttgggact

SEQ ID NO: 45534 - DNA, 24 bp, Homo sapiens
aaaaatgaaatgtaagattgcagg

SEQ ID NO: 45535 - DNA, 24 bp, Homo sapiens
aaaaaatgaaatgtaagattgcag

SEQ ID NO: 45536 - DNA, 24 bp, Homo sapiens
gaaaaaatgaaatgtaagattgca

SEQ ID NO: 45537 - DNA, 24 bp, Homo sapiens
tgggaggagtagagaggcaaggtc

SEQ ID NO: 45538 - DNA, 25 bp, Homo sapiens
gcatgtgacatttggaatgacagat

SEQ ID NO: 45539 - DNA, 25 bp, Homo sapiens
ttggactggatcgtaatgcatttcg

SEQ ID NO: 45540 - DNA, 24 bp, Homo sapiens
atacagtggaagtgttaaaaatag

SEQ ID NO: 45541 - DNA, 24 bp, Homo sapiens
gatacagtggaagtgttaaaaata

SEQ ID NO: 45542 - DNA, 24 bp, Homo sapiens
ggatacagtggaagtgttaaaaat

SEQ ID NO: 45543 - DNA, 24 bp, Homo sapiens
tctgctcccaggtgcactgcttgg

SEQ ID NO: 45544 - DNA, 24 bp, Homo sapiens
ctctgctcccaggtgcactgcttg

SEQ ID NO: 45545 - DNA, 24 bp, Homo sapiens
actctgctcccaggtgcactgctt

SEQ ID NO: 45546 - DNA, 24 bp, Homo sapiens
tctgctcccaggtgaggcgaggca

SEQ ID NO: 45547 - DNA, 24 bp, Homo sapiens
ctctgctcccaggtgaggcgaggc

SEQ ID NO: 45548 - DNA, 24 bp, Homo sapiens
actctgctcccaggtgaggcgagg

SEQ ID NO: 45549 - DNA, 24 bp, Homo sapiens
ccggtgctcaggtgggaacaggtg

SEQ ID NO: 45550 - DNA, 24 bp, Homo sapiens
gccggtgctcaggtgggaacaggt

SEQ ID NO: 45551 - DNA, 24 bp, Homo sapiens
ggccggtgctcaggtgggaacagg

SEQ ID NO: 45552 - DNA, 23 bp, Homo sapiens
caagagcatcgaggcagtggtgg

SEQ ID NO: 45553 - DNA, 23 bp, Homo sapiens
tagagaagcagaacggcctgagc

SEQ ID NO: 45554 - DNA, 23 bp, Homo sapiens
agacctgaggggcggaagccgag

SEQ ID NO: 45555 - DNA, 24 bp, Homo sapiens
gattatttcaggaaagaaaagcca

SEQ ID NO: 45556 - DNA, 24 bp, Homo sapiens
ggattatttcaggaaagaaaagcc

SEQ ID NO: 45557 - DNA, 24 bp, Homo sapiens
tggattatttcaggaaagaaaagc

SEQ ID NO: 45558 - DNA, 24 bp, Homo sapiens
taaaagaaaagggcaataaatact

SEQ ID NO: 45559 - DNA, 24 bp, Homo sapiens
ttaaaagaaaagggcaataaatac

SEQ ID NO: 45560 - DNA, 24 bp, Homo sapiens
tttaaaagaaaagggcaataaata

SEQ ID NO: 45561 - DNA, 24 bp, Homo sapiens
tcttttattagctgtcccatagtt

SEQ ID NO: 45562 - DNA, 24 bp, Homo sapiens
ctcttttattagctgtcccatagt

SEQ ID NO: 45563 - DNA, 24 bp, Homo sapiens
tctcttttattagctgtcccatag

SEQ ID NO: 45564 - DNA, 24 bp, Homo sapiens
acaaatataaagtaagattgtttt

SEQ ID NO: 45565 - DNA, 24 bp, Homo sapiens
gacaaatataaagtaagattgttt

SEQ ID NO: 45566 - DNA, 24 bp, Homo sapiens
tgacaaatataaagtaagattgtt

SEQ ID NO: 45567 - DNA, 24 bp, Homo sapiens
tgtatgaacaggtgcgagccaaat

SEQ ID NO: 45568 - DNA, 24 bp, Homo sapiens
gtgtatgaacaggtgcgagccaaa

SEQ ID NO: 45569 - DNA, 24 bp, Homo sapiens
agtgtatgaacaggtgcgagccaa

SEQ ID NO: 45570 - DNA, 24 bp, Homo sapiens
ttattaaaaaggtataatatgaat

SEQ ID NO: 45571 - DNA, 24 bp, Homo sapiens
gttattaaaaaggtataatatgaa

SEQ ID NO: 45572 - DNA, 24 bp, Homo sapiens
tgttattaaaaaggtataatatga

SEQ ID NO: 45573 - DNA, 24 bp, Homo sapiens
cttcacatatagtaagtgacatag

SEQ ID NO: 45574 - DNA, 24 bp, Homo sapiens
acttcacatatagtaagtgacata

SEQ ID NO: 45575 - DNA, 24 bp, Homo sapiens
tacttcacatatagtaagtgacat

SEQ ID NO: 45576 - DNA, 24 bp, Homo sapiens
ggattagaatcgtaagtgaaatat

SEQ ID NO: 45577 - DNA, 24 bp, Homo sapiens
aggattagaatcgtaagtgaaata

SEQ ID NO: 45578 - DNA, 24 bp, Homo sapiens
caggattagaatcgtaagtgaaat

SEQ ID NO: 45579 - DNA, 24 bp, Homo sapiens
catatactgaggttgtatatatat

SEQ ID NO: 45580 - DNA, 24 bp, Homo sapiens
ccatatactgaggttgtatatata

SEQ ID NO: 45581 - DNA, 24 bp, Homo sapiens
tccatatactgaggttgtatatat

SEQ ID NO: 45582 - DNA, 24 bp, Homo sapiens
tacggaaagctgactctcaacaaa

SEQ ID NO: 45583 - DNA, 24 bp, Homo sapiens
ttacggaaagctgactctcaacaa

SEQ ID NO: 45584 - DNA, 24 bp, Homo sapiens
gttacggaaagctgactctcaaca

SEQ ID NO: 45585 - DNA, 24 bp, Homo sapiens
tacggaaagctgtaagttaaaata

SEQ ID NO: 45586 - DNA, 24 bp, Homo sapiens
ttacggaaagctgtaagttaaaat

SEQ ID NO: 45587 - DNA, 24 bp, Homo sapiens
gttacggaaagctgtaagttaaaa

SEQ ID NO: 45588 - DNA, 24 bp, Homo sapiens
taacatatgaggtaagaagattta

SEQ ID NO: 45589 - DNA, 24 bp, Homo sapiens
ataacatatgaggtaagaagattt

SEQ ID NO: 45590 - DNA, 24 bp, Homo sapiens
gataacatatgaggtaagaagatt

SEQ ID NO: 45591 - DNA, 24 bp, Homo sapiens
aatgctgctgaacggcttgccact

SEQ ID NO: 45592 - DNA, 24 bp, Homo sapiens
aaagcaggaagtggagggaaatca

SEQ ID NO: 45593 - DNA, 24 bp, Homo sapiens
gccaatgatgttacaatctgcctt

SEQ ID NO: 45594 - DNA, 24 bp, Homo sapiens
aagcctggtgatgatgttattgaa

SEQ ID NO: 45595 - DNA, 24 bp, Homo sapiens
ttctccctggcaagtagtatctct

SEQ ID NO: 45596 - DNA, 24 bp, Homo sapiens
tggcatgacagattaaggaaggtt

SEQ ID NO: 45597 - DNA, 24 bp, Homo sapiens
ttattaaaaaggtgctgcaacttg

SEQ ID NO: 45598 - DNA, 24 bp, Homo sapiens
gttattaaaaaggtgctgcaactt

SEQ ID NO: 45599 - DNA, 24 bp, Homo sapiens
tgttattaaaaaggtgctgcaact

SEQ ID NO: 45600 - DNA, 23 bp, Homo sapiens
ttcggcggctgcgtggagaagtc

SEQ ID NO: 45601 - DNA, 23 bp, Homo sapiens
gcctaccgcatctcagcttcagc

SEQ ID NO: 45602 - DNA, 23 bp, Homo sapiens
gccagccagtttgtgaatgaggc

SEQ ID NO: 45603 - DNA, 24 bp, Homo sapiens
ttgtttttcaggatattagtaaag

SEQ ID NO: 45604 - DNA, 24 bp, Homo sapiens
gttgtttttcaggatattagtaaa

SEQ ID NO: 45605 - DNA, 24 bp, Homo sapiens
tgttgtttttcaggatattagtaa

SEQ ID NO: 45606 - DNA, 24 bp, Homo sapiens
attttatgttggatttccaattta

SEQ ID NO: 45607 - DNA, 24 bp, Homo sapiens
cattttatgttggatttccaattt

SEQ ID NO: 45608 - DNA, 24 bp, Homo sapiens
tcattttatgttggatttccaatt

SEQ ID NO: 45609 - DNA, 24 bp, Homo sapiens
gatggaatcagatatgtggtagat

SEQ ID NO: 45610 - DNA, 24 bp, Homo sapiens
agatggaatcagatatgtggtaga

SEQ ID NO: 45611 - DNA, 24 bp, Homo sapiens
tagatggaatcagatatgtggtag

SEQ ID NO: 45612 - DNA, 25 bp, Homo sapiens
ttgccaccaccacctggaattagaa

SEQ ID NO: 45613 - DNA, 25 bp, Homo sapiens
atgtggtagatggtggcttcgtgaa

SEQ ID NO: 45614 - DNA, 24 bp, Homo sapiens
ggttggacatcctggaggtggttc

SEQ ID NO: 45615 - DNA, 24 bp, Homo sapiens
ctcctgctatggtatgtagtgcag

SEQ ID NO: 45616 - DNA, 24 bp, Homo sapiens
cctcctgctatggtatgtagtgca

SEQ ID NO: 45617 - DNA, 24 bp, Homo sapiens
tcctcctgctatggtatgtagtgc

SEQ ID NO: 45618 - DNA, 23 bp, Homo sapiens
ctggctgaatgagtgcgtggagg

SEQ ID NO: 45619 - DNA, 25 bp, Homo sapiens
gctgctgtgtgtcatcctgtgtttg

SEQ ID NO: 45620 - DNA, 25 bp, Homo sapiens
acctctacctcctggattcaagcgg

SEQ ID NO: 45621 - DNA, 23 bp, Homo sapiens
gggacgatggcgggacgggtggc

SEQ ID NO: 45622 - DNA, 23 bp, Homo sapiens
tcctctttcgcgcccgctgccag

SEQ ID NO: 45623 - DNA, 23 bp, Homo sapiens
aggaccccgcaggcccgagtgcc

SEQ ID NO: 45624 - DNA, 23 bp, Homo sapiens
gactctgggagctagcgggagac

SEQ ID NO: 45625 - DNA, 23 bp, Homo sapiens
gtccgcccagccgacccctctgg

SEQ ID NO: 45626 - DNA, 24 bp, Homo sapiens
atgtggatgaagagagagccagga

SEQ ID NO: 45627 - DNA, 24 bp, Homo sapiens
catgtggatgaagagagagccagg

SEQ ID NO: 45628 - DNA, 24 bp, Homo sapiens
gcatgtggatgaagagagagccag

SEQ ID NO: 45629 - DNA, 23 bp, Homo sapiens
gaatctcccgcccagtctcaaac

SEQ ID NO: 45630 - DNA, 23 bp, Homo sapiens
cactgagctgagcggattccact

SEQ ID NO: 45631 - DNA, 23 bp, Homo sapiens
accggctccgcaatgaacaactt

SEQ ID NO: 45632 - DNA, 25 bp, Homo sapiens
actgacctctgataactggaacaca

SEQ ID NO: 45633 - DNA, 23 bp, Homo sapiens
atctcccgcccagtctcaaacca

SEQ ID NO: 45634 - DNA, 25 bp, Homo sapiens
ctttgaggagtagcacgcagagagt

SEQ ID NO: 45635 - DNA, 24 bp, Homo sapiens
gaaaagaaacaacttaaatcaact

SEQ ID NO: 45636 - DNA, 24 bp, Homo sapiens
agaaaagaaacaacttaaatcaac

SEQ ID NO: 45637 - DNA, 24 bp, Homo sapiens
aagaaaagaaacaacttaaatcaa

SEQ ID NO: 45638 - DNA, 25 bp, Homo sapiens
aagagctggagcacttcgagcaatc

SEQ ID NO: 45639 - DNA, 24 bp, Homo sapiens
gcccaacaccatgaacaactacgg

SEQ ID NO: 45640 - DNA, 23 bp, Homo sapiens
gacgagccgctgatgacaccact

SEQ ID NO: 45641 - DNA, 24 bp, Homo sapiens
aattttatcaggaagatgaagctc

SEQ ID NO: 45642 - DNA, 24 bp, Homo sapiens
aaattttatcaggaagatgaagct

SEQ ID NO: 45643 - DNA, 24 bp, Homo sapiens
taaattttatcaggaagatgaagc

SEQ ID NO: 45644 - DNA, 24 bp, Homo sapiens
taaaactggagaatcggagatcaa

SEQ ID NO: 45645 - DNA, 24 bp, Homo sapiens
ataaaactggagaatcggagatca

SEQ ID NO: 45646 - DNA, 24 bp, Homo sapiens
tataaaactggagaatcggagatc

SEQ ID NO: 45647 - DNA, 25 bp, Homo sapiens
gcctctcaggattccacacctactt

SEQ ID NO: 45648 - DNA, 24 bp, Homo sapiens
ctggaggctgtggtgtgcttcttc

SEQ ID NO: 45649 - DNA, 25 bp, Homo sapiens
agcctttgtgataactgcgtagaac

SEQ ID NO: 45650 - DNA, 24 bp, Homo sapiens
taacaaacaaggtgtgttttcaga

SEQ ID NO: 45651 - DNA, 24 bp, Homo sapiens
gtaacaaacaaggtgtgttttcag

SEQ ID NO: 45652 - DNA, 24 bp, Homo sapiens
tgtaacaaacaaggtgtgttttca

SEQ ID NO: 45653 - DNA, 24 bp, Homo sapiens
tgaatgtcgaggagttccaggatc

SEQ ID NO: 45654 - DNA, 24 bp, Homo sapiens
ctgaatgtcgaggagttccaggat

SEQ ID NO: 45655 - DNA, 24 bp, Homo sapiens
tctgaatgtcgaggagttccagga

SEQ ID NO: 45656 - DNA, 25 bp, Homo sapiens
gcaccagattaacatctacctcagc

SEQ ID NO: 45657 - DNA, 23 bp, Homo sapiens
atctcactgcaccgccgcctgcc

SEQ ID NO: 45658 - DNA, 23 bp, Homo sapiens
cagggcgaggagctgcggctgca

SEQ ID NO: 45659 - DNA, 25 bp, Homo sapiens
gtccgactgtattacatgcttcacc

SEQ ID NO: 45660 - DNA, 23 bp, Homo sapiens
atggagggtgtcctgccaagagg

SEQ ID NO: 45661 - DNA, 25 bp, Homo sapiens
aatggaagtgatgccgacatggtgg

SEQ ID NO: 45662 - DNA, 24 bp, Homo sapiens
gacatttgaaggtgtctggggaag

SEQ ID NO: 45663 - DNA, 24 bp, Homo sapiens
ggacatttgaaggtgtctggggaa

SEQ ID NO: 45664 - DNA, 24 bp, Homo sapiens
aggacatttgaaggtgtctgggga

SEQ ID NO: 45665 - DNA, 24 bp, Homo sapiens
aaattttaaagcttgtggttactg

SEQ ID NO: 45666 - DNA, 24 bp, Homo sapiens
gaaattttaaagcttgtggttact

SEQ ID NO: 45667 - DNA, 24 bp, Homo sapiens
agaaattttaaagcttgtggttac

SEQ ID NO: 45668 - DNA, 25 bp, Homo sapiens
ggagaatgaacccactttgaacctt

SEQ ID NO: 45669 - DNA, 24 bp, Homo sapiens
aatggaatcctctccacagagatc

SEQ ID NO: 45670 - DNA, 24 bp, Homo sapiens
ggtcgactcccagcattatgtgag

SEQ ID NO: 45671 - DNA, 23 bp, Homo sapiens
ggagcaggagccaggtggagtca

SEQ ID NO: 45672 - DNA, 25 bp, Homo sapiens
ccagaagagggttgagtaggaagcg

SEQ ID NO: 45673 - DNA, 23 bp, Homo sapiens
gcccagcattcagcaaggtccct

SEQ ID NO: 45674 - DNA, 23 bp, Homo sapiens
tgctggtggatgctgccgtggtg

SEQ ID NO: 45675 - DNA, 25 bp, Homo sapiens
cgccagggagttcgacattttctac

SEQ ID NO: 45676 - DNA, 23 bp, Homo sapiens
gagtggtgcctggccgtctggag

SEQ ID NO: 45677 - DNA, 23 bp, Homo sapiens
tgctggtggatgctgccgtggtg

SEQ ID NO: 45678 - DNA, 25 bp, Homo sapiens
gcactcgcaagagaaggtaattcct

SEQ ID NO: 45679 - DNA, 25 bp, Homo sapiens
caaggacctagaagacagatggagt

SEQ ID NO: 45680 - DNA, 23 bp, Homo sapiens
tggtgaggtggacaggaggtgac

SEQ ID NO: 45681 - DNA, 25 bp, Homo sapiens
aggagccgtggataatggaaggtga

SEQ ID NO: 45682 - DNA, 25 bp, Homo sapiens
tggagtggaggtgaaggaagtggag

SEQ ID NO: 45683 - DNA, 24 bp, Homo sapiens
agatgtcatggcaaaaattggatg

SEQ ID NO: 45684 - DNA, 24 bp, Homo sapiens
gagatgtcatggcaaaaattggat

SEQ ID NO: 45685 - DNA, 24 bp, Homo sapiens
cgagatgtcatggcaaaaattgga

SEQ ID NO: 45686 - DNA, 23 bp, Homo sapiens
tagatagggctgggcatggtggc

SEQ ID NO: 45687 - DNA, 24 bp, Homo sapiens
ggagccagtgtggatggttacagc

SEQ ID NO: 45688 - DNA, 23 bp, Homo sapiens
gcataatggatacaagggctcgc

SEQ ID NO: 45689 - DNA, 24 bp, Homo sapiens
aacatccgcagaaataaaaatgga

SEQ ID NO: 45690 - DNA, 24 bp, Homo sapiens
gaacatccgcagaaataaaaatgg

SEQ ID NO: 45691 - DNA, 24 bp, Homo sapiens
ggaacatccgcagaaataaaaatg

SEQ ID NO: 45692 - DNA, 24 bp, Homo sapiens
attctttcatggtaggtatggatt

SEQ ID NO: 45693 - DNA, 24 bp, Homo sapiens
aattctttcatggtaggtatggat

SEQ ID NO: 45694 - DNA, 24 bp, Homo sapiens
aaattctttcatggtaggtatgga

SEQ ID NO: 45695 - DNA, 24 bp, Homo sapiens
attctttcatgattcatgcccaag

SEQ ID NO: 45696 - DNA, 24 bp, Homo sapiens
aattctttcatgattcatgcccaa

SEQ ID NO: 45697 - DNA, 24 bp, Homo sapiens
aaattctttcatgattcatgccca

SEQ ID NO: 45698 - DNA, 24 bp, Homo sapiens
ttccaatacagataacaatgaaga

SEQ ID NO: 45699 - DNA, 24 bp, Homo sapiens
tttccaatacagataacaatgaag

SEQ ID NO: 45700 - DNA, 24 bp, Homo sapiens
ttttccaatacagataacaatgaa

SEQ ID NO: 45701 - DNA, 23 bp, Homo sapiens
cctggctgcggctgtgtcagatt

SEQ ID NO: 45702 - DNA, 25 bp, Homo sapiens
tgcctgaacacaagatccagtcatc

SEQ ID NO: 45703 - DNA, 24 bp, Homo sapiens
ttatcagcatcaagtggtggtggc

SEQ ID NO: 45704 - DNA, 25 bp, Homo sapiens
cctcaaccttccaggctcaagtgat

SEQ ID NO: 45705 - DNA, 23 bp, Homo sapiens
acaaggtgtcgctctgttgccca

SEQ ID NO: 45706 - DNA, 23 bp, Homo sapiens
tgtgaactctacagagccaaggc

SEQ ID NO: 45707 - DNA, 23 bp, Homo sapiens
gctcgtctcctgccttgagtcct

SEQ ID NO: 45708 - DNA, 24 bp, Homo sapiens
gtctcccacagagcctactccgag

SEQ ID NO: 45709 - DNA, 25 bp, Homo sapiens
ccttgtctgcttatcacactggctt

SEQ ID NO: 45710 - DNA, 24 bp, Homo sapiens
agaaggaaaagttaaaggagaaat

SEQ ID NO: 45711 - DNA, 24 bp, Homo sapiens
gagaaggaaaagttaaaggagaaa

SEQ ID NO: 45712 - DNA, 24 bp, Homo sapiens
ggagaaggaaaagttaaaggagaa

SEQ ID NO: 45713 - DNA, 24 bp, Homo sapiens
aaaacactcagaacctaaaaataa

SEQ ID NO: 45714 - DNA, 24 bp, Homo sapiens
taaaacactcagaacctaaaaata

SEQ ID NO: 45715 - DNA, 24 bp, Homo sapiens
ctaaaacactcagaacctaaaaat

SEQ ID NO: 45716 - DNA, 24 bp, Homo sapiens
gcaaaaccaaggttcccgtccgca

SEQ ID NO: 45717 - DNA, 24 bp, Homo sapiens
cgcaaaaccaaggttcccgtccgc

SEQ ID NO: 45718 - DNA, 24 bp, Homo sapiens
ccgcaaaaccaaggttcccgtccg

SEQ ID NO: 45719 - DNA, 25 bp, Homo sapiens
gtaacttgacctgctggagattcgg

SEQ ID NO: 45720 - DNA, 25 bp, Homo sapiens
gctgcctctgggtcattcaaagtct

SEQ ID NO: 45721 - DNA, 23 bp, Homo sapiens
tgggcgacagagcgagactttgt

SEQ ID NO: 45722 - DNA, 25 bp, Homo sapiens
tgttgcctttcagaccttcctttca

SEQ ID NO: 45723 - DNA, 23 bp, Homo sapiens
agacaccagttggagaggcggaa

SEQ ID NO: 45724 - DNA, 24 bp, Homo sapiens
ggctcttaccaggctcctcagact

SEQ ID NO: 45725 - DNA, 24 bp, Homo sapiens
aatttaataagacttatgaagagg

SEQ ID NO: 45726 - DNA, 24 bp, Homo sapiens
taatttaataagacttatgaagag

SEQ ID NO: 45727 - DNA, 24 bp, Homo sapiens
ttaatttaataagacttatgaaga

SEQ ID NO: 45728 - DNA, 24 bp, Homo sapiens
taattcaaaagttgttacaagaaa

SEQ ID NO: 45729 - DNA, 24 bp, Homo sapiens
ataattcaaaagttgttacaagaa

SEQ ID NO: 45730 - DNA, 24 bp, Homo sapiens
gataattcaaaagttgttacaaga

SEQ ID NO: 45731 - DNA, 24 bp, Homo sapiens
tcattttgtagtaccagataaaaa

SEQ ID NO: 45732 - DNA, 24 bp, Homo sapiens
ttcattttgtagtaccagataaaa

SEQ ID NO: 45733 - DNA, 24 bp, Homo sapiens
gttcattttgtagtaccagataaa

SEQ ID NO: 45734 - DNA, 24 bp, Homo sapiens
taaattttcaggactgtcaccagg

SEQ ID NO: 45735 - DNA, 24 bp, Homo sapiens
ttaaattttcaggactgtcaccag

SEQ ID NO: 45736 - DNA, 24 bp, Homo sapiens
tttaaattttcaggactgtcacca

SEQ ID NO: 45737 - DNA, 25 bp, Homo sapiens
gaggaatggagattgcttgatgacg

SEQ ID NO: 45738 - DNA, 23 bp, Homo sapiens
ggctcctctaccgcaatgtgatg

SEQ ID NO: 45739 - DNA, 23 bp, Homo sapiens
aactttacacttctggcctctct

SEQ ID NO: 45740 - DNA, 24 bp, Homo sapiens
tgcctagaaaggtggccttggaga

SEQ ID NO: 45741 - DNA, 24 bp, Homo sapiens
gtgcctagaaaggtggccttggag

SEQ ID NO: 45742 - DNA, 24 bp, Homo sapiens
agtgcctagaaaggtggccttgga

SEQ ID NO: 45743 - DNA, 24 bp, Homo sapiens
ttatttcacagaattacaagtata

SEQ ID NO: 45744 - DNA, 24 bp, Homo sapiens
tttatttcacagaattacaagtat

SEQ ID NO: 45745 - DNA, 24 bp, Homo sapiens
ttttatttcacagaattacaagta

SEQ ID NO: 45746 - DNA, 24 bp, Homo sapiens
tttatctctagctgatgagatgga

SEQ ID NO: 45747 - DNA, 24 bp, Homo sapiens
ttttatctctagctgatgagatgg

SEQ ID NO: 45748 - DNA, 24 bp, Homo sapiens
tttttatctctagctgatgagatg

SEQ ID NO: 45749 - DNA, 25 bp, Homo sapiens
cagcacattagcagtagaaggcaca

SEQ ID NO: 45750 - DNA, 25 bp, Homo sapiens
tagggcaggagtgaaaggcaaagga

SEQ ID NO: 45751 - DNA, 25 bp, Homo sapiens
cgcacaacagtggtactaagcacaa

SEQ ID NO: 45752 - DNA, 25 bp, Homo sapiens
tagggcaggagtgaaaggcaaagga

SEQ ID NO: 45753 - DNA, 25 bp, Homo sapiens
cgcacaacagtggtactaagcacaa

SEQ ID NO: 45754 - DNA, 25 bp, Homo sapiens
acggcttctttactgttcgctatgc

SEQ ID NO: 45755 - DNA, 23 bp, Homo sapiens
cctcctccacctccacctccacc

SEQ ID NO: 45756 - DNA, 23 bp, Homo sapiens
tccacctctgcggctcctacctg

SEQ ID NO: 45757 - DNA, 23 bp, Homo sapiens
caagctcatcaatggcggcatcg

SEQ ID NO: 45758 - DNA, 23 bp, Homo sapiens
catgtggtggtggacgcctgctc

SEQ ID NO: 45759 - DNA, 23 bp, Homo sapiens
atgagacagagtggtgccttcct

SEQ ID NO: 45760 - DNA, 23 bp, Homo sapiens
gaaactcatcaaggagcccgccc

SEQ ID NO: 45761 - DNA, 23 bp, Homo sapiens
tgacggagcagtacccacaaggc

SEQ ID NO: 45762 - DNA, 25 bp, Homo sapiens
ctctctacccacagaacacgaccct

SEQ ID NO: 45763 - DNA, 23 bp, Homo sapiens
catgtggtggtggacgcctgctc

SEQ ID NO: 45764 - DNA, 24 bp, Homo sapiens
agctggaccaggcgaagcccctgg

SEQ ID NO: 45765 - DNA, 24 bp, Homo sapiens
cagctggaccaggcgaagcccctg

SEQ ID NO: 45766 - DNA, 24 bp, Homo sapiens
ccagctggaccaggcgaagcccct

SEQ ID NO: 45767 - DNA, 24 bp, Homo sapiens
atatgtcacaggaccttatggatt

SEQ ID NO: 45768 - DNA, 24 bp, Homo sapiens
aatatgtcacaggaccttatggat

SEQ ID NO: 45769 - DNA, 24 bp, Homo sapiens
aaatatgtcacaggaccttatgga

SEQ ID NO: 45770 - DNA, 24 bp, Homo sapiens
tttttaatgctgtaagtcttaact

SEQ ID NO: 45771 - DNA, 24 bp, Homo sapiens
atttttaatgctgtaagtcttaac

SEQ ID NO: 45772 - DNA, 24 bp, Homo sapiens
atttttaatgctgtaagtcttaac

SEQ ID NO: 45773 - DNA, 25 bp, Homo sapiens
cctccgcttcctatcctagtccaga

SEQ ID NO: 45774 - DNA, 23 bp, Homo sapiens
ttggactcgcattcaggacgcct

SEQ ID NO: 45775 - DNA, 23 bp, Homo sapiens
acccatcaccacctctgcccttt

SEQ ID NO: 45776 - DNA, 24 bp, Homo sapiens
ggacaaacaagcatttcaaaaggt

SEQ ID NO: 45777 - DNA, 24 bp, Homo sapiens
aggacaaacaagcatttcaaaagg

SEQ ID NO: 45778 - DNA, 24 bp, Homo sapiens
taggacaaacaagcatttcaaaag

SEQ ID NO: 45779 - DNA, 24 bp, Homo sapiens
gaaagaaatgggagaagcatttga

SEQ ID NO: 45780 - DNA, 24 bp, Homo sapiens
tgaaagaaatgggagaagcatttg

SEQ ID NO: 45781 - DNA, 24 bp, Homo sapiens
atgaaagaaatgggagaagcattt

SEQ ID NO: 45782 - DNA, 24 bp, Homo sapiens
gacatttctgggtcaactgctacc

SEQ ID NO: 45783 - DNA, 24 bp, Homo sapiens
ggacatttctgggtcaactgctac

SEQ ID NO: 45784 - DNA, 24 bp, Homo sapiens
gggacatttctgggtcaactgcta

SEQ ID NO: 45785 - DNA, 24 bp, Homo sapiens
ttgctcctcacatcatctattgtt

SEQ ID NO: 45786 - DNA, 24 bp, Homo sapiens
attgctcctcacatcatctattgt

SEQ ID NO: 45787 - DNA, 24 bp, Homo sapiens
gattgctcctcacatcatctattg

SEQ ID NO: 45788 - DNA, 23 bp, Homo sapiens
agcacacaacgcacatcctgaag

SEQ ID NO: 45789 - DNA, 23 bp, Homo sapiens
cgctggagtggtggaccaacatg

SEQ ID NO: 45790 - DNA, 25 bp, Homo sapiens
tccgaatacactggcaaaggcaaca

SEQ ID NO: 45791 - DNA, 23 bp, Homo sapiens
cgtctcgtgtgggtgccttcgga

SEQ ID NO: 45792 - DNA, 23 bp, Homo sapiens
gaaggcgaggaggaggcggaggt

SEQ ID NO: 45793 - DNA, 23 bp, Homo sapiens
ccgagctgacctgcctcaacgag

SEQ ID NO: 45794 - DNA, 25 bp, Homo sapiens
acaatggcatgatctcggctcactg

SEQ ID NO: 45795 - DNA, 23 bp, Homo sapiens
agacggagtctcactctgtcgcc

SEQ ID NO: 45796 - DNA, 25 bp, Homo sapiens
gcccaaagttgtttgtttgcttgtt

SEQ ID NO: 45797 - DNA, 24 bp, Homo sapiens
tcattctctaggaaatggaaaatt

SEQ ID NO: 45798 - DNA, 24 bp, Homo sapiens
atcattctctaggaaatggaaaat

SEQ ID NO: 45799 - DNA, 24 bp, Homo sapiens
catcattctctaggaaatggaaaa

SEQ ID NO: 45800 - DNA, 24 bp, Homo sapiens
accaaagaaaattccatcattttg

SEQ ID NO: 45801 - DNA, 24 bp, Homo sapiens
caccaaagaaaattccatcatttt

SEQ ID NO: 45802 - DNA, 24 bp, Homo sapiens
gcaccaaagaaaattccatcattt

SEQ ID NO: 45803 - DNA, 24 bp, Homo sapiens
tgtttttaaagttgaagaaaatcc

SEQ ID NO: 45804 - DNA, 24 bp, Homo sapiens
ttgtttttaaagttgaagaaaatc

SEQ ID NO: 45805 - DNA, 24 bp, Homo sapiens
tttgtttttaaagttgaagaaaat

SEQ ID NO: 45806 - DNA, 24 bp, Homo sapiens
ctcagctcttagtaagttgaaatc

SEQ ID NO: 45807 - DNA, 24 bp, Homo sapiens
actcagctcttagtaagttgaaat

SEQ ID NO: 45808 - DNA, 24 bp, Homo sapiens
cactcagctcttagtaagttgaaa

SEQ ID NO: 45809 - DNA, 24 bp, Homo sapiens
taggtcgccagctttccagtcact

SEQ ID NO: 45810 - DNA, 24 bp, Homo sapiens
tcaggctgggagaggtcaccgctc

SEQ ID NO: 45811 - DNA, 24 bp, Homo sapiens
cctcccaccctcacctcccagacc

SEQ ID NO: 45812 - DNA, 24 bp, Homo sapiens
ggccccagcaagccccagcagccc

SEQ ID NO: 45813 - DNA, 24 bp, Homo sapiens
cggccccagcaagccccagcagcc

SEQ ID NO: 45814 - DNA, 24 bp, Homo sapiens
acggccccagcaagccccagcagc

SEQ ID NO: 45815 - DNA, 25 bp, Homo sapiens
acacagtcaagaaggtcaagattgg

SEQ ID NO: 45816 - DNA, 23 bp, Homo sapiens
ccagcccattgagtggaagcagc

SEQ ID NO: 45817 - DNA, 25 bp, Homo sapiens
tgctgagggctgacataaggaagga

SEQ ID NO: 45818 - DNA, 23 bp, Homo sapiens
agcagccccagccccagccccag

SEQ ID NO: 45819 - DNA, 23 bp, Homo sapiens
gcccggagaggctctgcagccat

SEQ ID NO: 45820 - DNA, 23 bp, Homo sapiens
agcagcagcagcagcccctgctc

SEQ ID NO: 45821 - DNA, 24 bp, Homo sapiens
gtcataatagagatacaaactggc

SEQ ID NO: 45822 - DNA, 24 bp, Homo sapiens
cgtcataatagagatacaaactgg

SEQ ID NO: 45823 - DNA, 24 bp, Homo sapiens
gcgtcataatagagatacaaactg

SEQ ID NO: 45824 - DNA, 24 bp, Homo sapiens
agatgacaaaggtaaagaattttt

SEQ ID NO: 45825 - DNA, 24 bp, Homo sapiens
aagatgacaaaggtaaagaatttt

SEQ ID NO: 45826 - DNA, 24 bp, Homo sapiens
aaagatgacaaaggtaaagaattt

SEQ ID NO: 45827 - DNA, 23 bp, Homo sapiens
cctggactgtaagcgtgtggtgc

SEQ ID NO: 45828 - DNA, 25 bp, Homo sapiens
cctggctgaagactgctggatgaag

SEQ ID NO: 45829 - DNA, 23 bp, Homo sapiens
gggaagtcaggcagcagatggga

SEQ ID NO: 45830 - DNA, 25 bp, Homo sapiens
tgagaccagcctgaccaatatgatg

SEQ ID NO: 45831 - DNA, 25 bp, Homo sapiens
ctggctgctttgtagagaactgcgt

SEQ ID NO: 45832 - DNA, 24 bp, Homo sapiens
gctgtgtgcctcaattctttgcct

SEQ ID NO: 45833 - DNA, 25 bp, Homo sapiens
ggatggatggatggatggatggacg

SEQ ID NO: 45834 - DNA, 25 bp, Homo sapiens
agataccatgtcctctgtgaaggct

SEQ ID NO: 45835 - DNA, 25 bp, Homo sapiens
gccctcagataagccatccatattt

SEQ ID NO: 45836 - DNA, 23 bp, Homo sapiens
gatgtgacgctggagaacctggc

SEQ ID NO: 45837 - DNA, 25 bp, Homo sapiens
gttggtgtggagtggaagatgaggc

SEQ ID NO: 45838 - DNA, 23 bp, Homo sapiens
gcaggtgtgtctcccaagaaggc

SEQ ID NO: 45839 - DNA, 24 bp, Homo sapiens
cattattaaaggtcagttttagga

SEQ ID NO: 45840 - DNA, 24 bp, Homo sapiens
tcattattaaaggtcagttttagg

SEQ ID NO: 45841 - DNA, 24 bp, Homo sapiens
ttcattattaaaggtcagttttag

SEQ ID NO: 45842 - DNA, 24 bp, Homo sapiens
acatgtcaaaggtaaataactttt

SEQ ID NO: 45843 - DNA, 24 bp, Homo sapiens
cacatgtcaaaggtaaataacttt

SEQ ID NO: 45844 - DNA, 24 bp, Homo sapiens
tcacatgtcaaaggtaaataactt

SEQ ID NO: 45845 - DNA, 24 bp, Homo sapiens
aatagttgatggtgtttacatagg

SEQ ID NO: 45846 - DNA, 24 bp, Homo sapiens
caatagttgatggtgtttacatag

SEQ ID NO: 45847 - DNA, 24 bp, Homo sapiens
acaatagttgatggtgtttacata

SEQ ID NO: 45848 - DNA, 24 bp, Homo sapiens
atataataaagaaaatccagtgtt

SEQ ID NO: 45849 - DNA, 24 bp, Homo sapiens
tatataataaagaaaatccagtgt

SEQ ID NO: 45850 - DNA, 24 bp, Homo sapiens
gtatataataaagaaaatccagtg

SEQ ID NO: 45851 - DNA, 25 bp, Homo sapiens
aaggaagaagaagcagcagccagaa

SEQ ID NO: 45852 - DNA, 24 bp, Homo sapiens
gctgtgcgagtccttctggaagag

SEQ ID NO: 45853 - DNA, 25 bp, Homo sapiens
aaggaagaagaagcagcagccagaa

SEQ ID NO: 45854 - DNA, 24 bp, Homo sapiens
gctgtgcgagtccttctggaagag

SEQ ID NO: 45855 - DNA, 23 bp, Homo sapiens
actgtcctactgtgcctgatgaa

SEQ ID NO: 45856 - DNA, 25 bp, Homo sapiens
aaggaagaagaagcagcagccagaa

SEQ ID NO: 45857 - DNA, 24 bp, Homo sapiens
gctgtgcgagtccttctggaagag

SEQ ID NO: 45858 - DNA, 25 bp, Homo sapiens
caaggatcgtaattggctgttgagg

SEQ ID NO: 45859 - DNA, 24 bp, Homo sapiens
aactgctcaaagtatataattcta

SEQ ID NO: 45860 - DNA, 24 bp, Homo sapiens
aaactgctcaaagtatataattct

SEQ ID NO: 45861 - DNA, 24 bp, Homo sapiens
caaactgctcaaagtatataattc

SEQ ID NO: 45862 - DNA, 23 bp, Homo sapiens
cgattctcgtgcctcagcctccc

SEQ ID NO: 45863 - DNA, 24 bp, Homo sapiens
gcgggcgtccctgagagaaattag

SEQ ID NO: 45864 - DNA, 23 bp, Homo sapiens
ttcgaagattgtttcagaagcgt

SEQ ID NO: 45865 - DNA, 25 bp, Homo sapiens
aacttgatgaggacattatcccaga

SEQ ID NO: 45866 - DNA, 25 bp, Homo sapiens
tgaaccattaaatgaaacaacagca

SEQ ID NO: 45867 - DNA, 25 bp, Homo sapiens
ttcctacttcaacagaagaacaata

SEQ ID NO: 45868 - DNA, 23 bp, Homo sapiens
cgattctcgtgcctcagcctccc

SEQ ID NO: 45869 - DNA, 24 bp, Homo sapiens
cggggcgtccctgagagaaattag

SEQ ID NO: 45870 - DNA, 23 bp, Homo sapiens
gcttcgaagattgtttcagaagc

SEQ ID NO: 45871 - DNA, 24 bp, Homo sapiens
aagcgtctcagttagcagcaccag

SEQ ID NO: 45872 - DNA, 25 bp, Homo sapiens
aggctgggaagtccaagatcaaggt

SEQ ID NO: 45873 - DNA, 25 bp, Homo sapiens
tggtgactgttgagagccttcttgc

SEQ ID NO: 45874 - DNA, 24 bp, Homo sapiens
ccgatcctcagatgaacccgaatg

SEQ ID NO: 45875 - DNA, 24 bp, Homo sapiens
gccgatcctcagatgaacccgaat

SEQ ID NO: 45876 - DNA, 24 bp, Homo sapiens
cgccgatcctcagatgaacccgaa

SEQ ID NO: 45877 - DNA, 24 bp, Homo sapiens
ataaggaaaaggttaaagaattgc

SEQ ID NO: 45878 - DNA, 24 bp, Homo sapiens
gataaggaaaaggttaaagaattg

SEQ ID NO: 45879 - DNA, 24 bp, Homo sapiens
cgataaggaaaaggttaaagaatt

SEQ ID NO: 45880 - DNA, 24 bp, Homo sapiens
ggtgatgctgctgccagatgactt

SEQ ID NO: 45881 - DNA, 23 bp, Homo sapiens
gctggtgggtgtgttcctgtggg

SEQ ID NO: 45882 - DNA, 23 bp, Homo sapiens
cagcagaaggtgaaggtgttccg

SEQ ID NO: 45883 - DNA, 24 bp, Homo sapiens
agtgatcctcctgccttagcctcc

SEQ ID NO: 45884 - DNA, 24 bp, Homo sapiens
tcatagctccctgaggtcttcacc

SEQ ID NO: 45885 - DNA, 23 bp, Homo sapiens
gttgcccagactcgagtgcggtg

SEQ ID NO: 45886 - DNA, 24 bp, Homo sapiens
tgttataacagattggagaaatat

SEQ ID NO: 45887 - DNA, 24 bp, Homo sapiens
ttgttataacagattggagaaata

SEQ ID NO: 45888 - DNA, 24 bp, Homo sapiens
tttgttataacagattggagaaat

SEQ ID NO: 45889 - DNA, 24 bp, Homo sapiens
aaactgtgtgggtgacttaatgaa

SEQ ID NO: 45890 - DNA, 24 bp, Homo sapiens
aaaactgtgtgggtgacttaatga

SEQ ID NO: 45891 - DNA, 24 bp, Homo sapiens
taaaactgtgtgggtgacttaatg

SEQ ID NO: 45892 - DNA, 24 bp, Homo sapiens
gaagatcattgattttgaaaattt

SEQ ID NO: 45893 - DNA, 24 bp, Homo sapiens
ggaagatcattgattttgaaaatt

SEQ ID NO: 45894 - DNA, 24 bp, Homo sapiens
gggaagatcattgattttgaaaat

SEQ ID NO: 45895 - DNA, 24 bp, Homo sapiens
atttgttagcaatacaaaaaaacc

SEQ ID NO: 45896 - DNA, 24 bp, Homo sapiens
gatttgttagcaatacaaaaaaac

SEQ ID NO: 45897 - DNA, 24 bp, Homo sapiens
ggatttgttagcaatacaaaaaaa

SEQ ID NO: 45898 - DNA, 25 bp, Homo sapiens
ttgctgtgcctgtgcctctatgatg

SEQ ID NO: 45899 - DNA, 24 bp, Homo sapiens
accgcacccacctcaacttctact

SEQ ID NO: 45900 - DNA, 23 bp, Homo sapiens
ctgtcgttcctggcgttctgggt

SEQ ID NO: 45901 - DNA, 23 bp, Homo sapiens
caggaggcggaagttgtggtgag

SEQ ID NO: 45902 - DNA, 23 bp, Homo sapiens
caatggcacgatctcggctcacg

SEQ ID NO: 45903 - DNA, 23 bp, Homo sapiens
aggctggtcttgtactcctgacg

SEQ ID NO: 45904 - DNA, 24 bp, Homo sapiens
ggagaggaattaaaggtacttaag

SEQ ID NO: 45905 - DNA, 24 bp, Homo sapiens
aggagaggaattaaaggtacttaa

SEQ ID NO: 45906 - DNA, 24 bp, Homo sapiens
gaggagaggaattaaaggtactta

SEQ ID NO: 45907 - DNA, 24 bp, Homo sapiens
gctgctgctgggagttgactacat

SEQ ID NO: 45908 - DNA, 23 bp, Homo sapiens
ccagccattgtcaagttccatgc

SEQ ID NO: 45909 - DNA, 25 bp, Homo sapiens
acaagaaagccaaacgaggagagga

SEQ ID NO: 45910 - DNA, 23 bp, Homo sapiens
cacactgccactccaccaccact

SEQ ID NO: 45911 - DNA, 24 bp, Homo sapiens
tgagttgacgaccttgaggagcca

SEQ ID NO: 45912 - DNA, 25 bp, Homo sapiens
accatccatcagagtgtagtgacca

SEQ ID NO: 45913 - DNA, 23 bp, Homo sapiens
gcactcttcgtggacttggagcc

SEQ ID NO: 45914 - DNA, 23 bp, Homo sapiens
ccagcaccgttcactcttccacc

SEQ ID NO: 45915 - DNA, 25 bp, Homo sapiens
aggaggatgctgccaacaattacgc

SEQ ID NO: 45916 - DNA, 24 bp, Homo sapiens
ttttcattaaggaaattccattct

SEQ ID NO: 45917 - DNA, 24 bp, Homo sapiens
tttttcattaaggaaattccattc

SEQ ID NO: 45918 - DNA, 24 bp, Homo sapiens
ttttttcattaaggaaattccatt

SEQ ID NO: 45919 - DNA, 24 bp, Homo sapiens
ctattccgcaggtgtccctggctg

SEQ ID NO: 45920 - DNA, 24 bp, Homo sapiens
actattccgcaggtgtccctggct

SEQ ID NO: 45921 - DNA, 24 bp, Homo sapiens
tactattccgcaggtgtccctggc

SEQ ID NO: 45922 - DNA, 24 bp, Homo sapiens
ttttattgtaggtactaaacagac

SEQ ID NO: 45923 - DNA, 24 bp, Homo sapiens
tttttattgtaggtactaaacaga

SEQ ID NO: 45924 - DNA, 24 bp, Homo sapiens
atttttattgtaggtactaaacag

SEQ ID NO: 45925 - DNA, 24 bp, Homo sapiens
tttctactaaggcttgtaatgaac

SEQ ID NO: 45926 - DNA, 24 bp, Homo sapiens
atttctactaaggcttgtaatgaa

SEQ ID NO: 45927 - DNA, 24 bp, Homo sapiens
catttctactaaggcttgtaatga

SEQ ID NO: 45928 - DNA, 24 bp, Homo sapiens
agcttatgttgatgaagaacttcc

SEQ ID NO: 45929 - DNA, 24 bp, Homo sapiens
gagcttatgttgatgaagaacttc

SEQ ID NO: 45930 - DNA, 24 bp, Homo sapiens
ggagcttatgttgatgaagaactt

SEQ ID NO: 45931 - DNA, 24 bp, Homo sapiens
aaaaaatcaaggtaataacttaaa

SEQ ID NO: 45932 - DNA, 24 bp, Homo sapiens
aaaaaaatcaaggtaataacttaa

SEQ ID NO: 45933 - DNA, 24 bp, Homo sapiens
gaaaaaaatcaaggtaataactta

SEQ ID NO: 45934 - DNA, 23 bp, Homo sapiens
cgcaggaacaggacatacggtgg

SEQ ID NO: 45935 - DNA, 23 bp, Homo sapiens
agcctctcgccgtttctacccag

SEQ ID NO: 45936 - DNA, 23 bp, Homo sapiens
cagcccaaggtcacacagcgaag

SEQ ID NO: 45937 - DNA, 24 bp, Homo sapiens
cggggcctcgggctaaaaccagaa

SEQ ID NO: 45938 - DNA, 24 bp, Homo sapiens
gcggggcctcgggctaaaaccaga

SEQ ID NO: 45939 - DNA, 24 bp, Homo sapiens
tgcggggcctcgggctaaaaccag

SEQ ID NO: 45940 - DNA, 24 bp, Homo sapiens
tggtggctgggatgttcctggttc

SEQ ID NO: 45941 - DNA, 24 bp, Homo sapiens
gtggtggctgggatgttcctggtt

SEQ ID NO: 45942 - DNA, 24 bp, Homo sapiens
ggtggtggctgggatgttcctggt

SEQ ID NO: 45943 - DNA, 23 bp, Homo sapiens
aatcaggcttgagtgcagtggcg

SEQ ID NO: 45944 - DNA, 23 bp, Homo sapiens
aggttctgggaagtctcggtggg

SEQ ID NO: 45945 - DNA, 24 bp, Homo sapiens
gcccagaagtggaataattcagga

SEQ ID NO: 45946 - DNA, 24 bp, Homo sapiens
caccctgcggctgacatctcctgc

SEQ ID NO: 45947 - DNA, 24 bp, Homo sapiens
tccaacaatagagcccaagccatt

SEQ ID NO: 45948 - DNA, 24 bp, Homo sapiens
gcagcagttacccgcataccaagg

SEQ ID NO: 45949 - DNA, 24 bp, Homo sapiens
tccaacaatagagcccaagccatt

SEQ ID NO: 45950 - DNA, 24 bp, Homo sapiens
gcagcagttacccgcataccaagg

SEQ ID NO: 45951 - DNA, 24 bp, Homo sapiens
gatggatggctgtgctgggatgac

SEQ ID NO: 45952 - DNA, 24 bp, Homo sapiens
gatggatggctgtgctgggatgac

SEQ ID NO: 45953 - DNA, 24 bp, Homo sapiens
gcagcagttacccgcataccaagg

SEQ ID NO: 45954 - DNA, 24 bp, Homo sapiens
aggacgaaagaagatgatggatgc

SEQ ID NO: 45955 - DNA, 23 bp, Homo sapiens
ggaacaagagcctcaggagcaag

SEQ ID NO: 45956 - DNA, 23 bp, Homo sapiens
gctgccagttgtctcggatcgga

SEQ ID NO: 45957 - DNA, 23 bp, Homo sapiens
ggtgggtgctggctgggatcttg

SEQ ID NO: 45958 - DNA, 23 bp, Homo sapiens
agtaaaccactgggagtccggca

SEQ ID NO: 45959 - DNA, 23 bp, Homo sapiens
cagagtcccgttgctccgccgcg

SEQ ID NO: 45960 - DNA, 23 bp, Homo sapiens
gtggtggtcggcggcggcatcgc

SEQ ID NO: 45961 - DNA, 24 bp, Homo sapiens
tactacaagtgacccaacatttag

SEQ ID NO: 45962 - DNA, 24 bp, Homo sapiens
ttactacaagtgacccaacattta

SEQ ID NO: 45963 - DNA, 24 bp, Homo sapiens
cttactacaagtgacccaacattt

SEQ ID NO: 45964 - DNA, 24 bp, Homo sapiens
ttttatttcagaatgaaattcacc

SEQ ID NO: 45965 - DNA, 24 bp, Homo sapiens
tttttatttcagaatgaaattcac

SEQ ID NO: 45966 - DNA, 24 bp, Homo sapiens
atttttatttcagaatgaaattca

SEQ ID NO: 45967 - DNA, 24 bp, Homo sapiens
agtaaaagaaggtaaaggctttat

SEQ ID NO: 45968 - DNA, 24 bp, Homo sapiens
aagtaaaagaaggtaaaggcttta

SEQ ID NO: 45969 - DNA, 24 bp, Homo sapiens
aaagtaaaagaaggtaaaggcttt

SEQ ID NO: 45970 - DNA, 24 bp, Homo sapiens
attattcttagtgcatccaagact

SEQ ID NO: 45971 - DNA, 24 bp, Homo sapiens
tattattcttagtgcatccaagac

SEQ ID NO: 45972 - DNA, 24 bp, Homo sapiens
ctattattcttagtgcatccaaga

SEQ ID NO: 45973 - DNA, 25 bp, Homo sapiens
agattgactttgaagaacaattcct

SEQ ID NO: 45974 - DNA, 25 bp, Homo sapiens
aatagttgatttgtccactaaagtg

SEQ ID NO: 45975 - DNA, 23 bp, Homo sapiens
aaagagctcaagctcgttatgaa

SEQ ID NO: 45976 - DNA, 24 bp, Homo sapiens
atcacagacagctctctacgagca

SEQ ID NO: 45977 - DNA, 24 bp, Homo sapiens
catcacagacagctctctacgagc

SEQ ID NO: 45978 - DNA, 24 bp, Homo sapiens
gcatcacagacagctctctacgag

SEQ ID NO: 45979 - DNA, 25 bp, Homo sapiens
accttctcctgctgctacttcttcc

SEQ ID NO: 45980 - DNA, 24 bp, Homo sapiens
cagcctgggtgacagagcaagaaa

SEQ ID NO: 45981 - DNA, 25 bp, Homo sapiens
gcactgtaatcttcatgtcagcaac

SEQ ID NO: 45982 - DNA, 23 bp, Homo sapiens
ccaagaccgctgtgtggaggtag

SEQ ID NO: 45983 - DNA, 23 bp, Homo sapiens
gcgttatttggttggtgcctgcg

SEQ ID NO: 45984 - DNA, 24 bp, Homo sapiens
cgtggagggtcaagtggcttcttc

SEQ ID NO: 45985 - DNA, 24 bp, Homo sapiens
atattaatcaagtaaagctctaat

SEQ ID NO: 45986 - DNA, 24 bp, Homo sapiens
tatattaatcaagtaaagctctaa

SEQ ID NO: 45987 - DNA, 24 bp, Homo sapiens
ctatattaatcaagtaaagctcta

SEQ ID NO: 45988 - DNA, 24 bp, Homo sapiens
atttcccatagcaaaacccttgaa

SEQ ID NO: 45989 - DNA, 24 bp, Homo sapiens
aatttcccatagcaaaacccttga

SEQ ID NO: 45990 - DNA, 24 bp, Homo sapiens
gaatttcccatagcaaaacccttg

SEQ ID NO: 45991 - DNA, 24 bp, Homo sapiens
tcaacaatcatgaccaagccatat

SEQ ID NO: 45992 - DNA, 24 bp, Homo sapiens
ctcaacaatcatgaccaagccata

SEQ ID NO: 45993 - DNA, 24 bp, Homo sapiens
cctcaacaatcatgaccaagccat

SEQ ID NO: 45994 - DNA, 25 bp, Homo sapiens
cggagttaccaggagctagtgaagg

SEQ ID NO: 45995 - DNA, 23 bp, Homo sapiens
acagaggaggcacagaggcactt

SEQ ID NO: 45996 - DNA, 25 bp, Homo sapiens
ggctgcgtatgaagtcctgagtcaa

SEQ ID NO: 45997 - DNA, 23 bp, Homo sapiens
gctcagtgtgcggctctatcgtc

SEQ ID NO: 45998 - DNA, 23 bp, Homo sapiens
ggtcttgctggtggctgctgttg

SEQ ID NO: 45999 - DNA, 24 bp, Homo sapiens
tctgagtcccattcgctttgctgc

SEQ ID NO: 46000 - DNA, 24 bp, Homo sapiens
gatctgaataggtaaatgaatata

SEQ ID NO: 46001 - DNA, 24 bp, Homo sapiens
tgatctgaataggtaaatgaatat

SEQ ID NO: 46002 - DNA, 24 bp, Homo sapiens
ttgatctgaataggtaaatgaata

SEQ ID NO: 46003 - DNA, 24 bp, Homo sapiens
cacgcccgctgcccacccaccccc

SEQ ID NO: 46004 - DNA, 24 bp, Homo sapiens
ccacgcccgctgcccacccacccc

SEQ ID NO: 46005 - DNA, 24 bp, Homo sapiens
cccacgcccgctgcccacccaccc

SEQ ID NO: 46006 - DNA, 24 bp, Homo sapiens
aaaagatatgactgttgttgcttt

SEQ ID NO: 46007 - DNA, 24 bp, Homo sapiens
taaaagatatgactgttgttgctt

SEQ ID NO: 46008 - DNA, 24 bp, Homo sapiens
ataaaagatatgactgttgttgct

SEQ ID NO: 46009 - DNA, 24 bp, Homo sapiens
tacatcaaaaggcaaacagattac

SEQ ID NO: 46010 - DNA, 24 bp, Homo sapiens
ttacatcaaaaggcaaacagatta

SEQ ID NO: 46011 - DNA, 24 bp, Homo sapiens
tttacatcaaaaggcaaacagatt

SEQ ID NO: 46012 - DNA, 24 bp, Homo sapiens
aaataaaaaaggatgaaaacacac

SEQ ID NO: 46013 - DNA, 24 bp, Homo sapiens
aaaataaaaaaggatgaaaacaca

SEQ ID NO: 46014 - DNA, 24 bp, Homo sapiens
gaaaataaaaaaggatgaaaacac

SEQ ID NO: 46015 - DNA, 24 bp, Homo sapiens
atgccataacactcagcgagaccg

SEQ ID NO: 46016 - DNA, 25 bp, Homo sapiens
caggagtgtggtgatggtggtcttc

SEQ ID NO: 46017 - DNA, 23 bp, Homo sapiens
ggcagcatacggcgaagcagagg

SEQ ID NO: 46018 - DNA, 25 bp, Homo sapiens
ccaaatctctccgtcagaagcaggg

SEQ ID NO: 46019 - DNA, 24 bp, Homo sapiens
atgccataacactcagcgagaccg

SEQ ID NO: 46020 - DNA, 25 bp, Homo sapiens
caggagtgtggtgatggtggtcttc

SEQ ID NO: 46021 - DNA, 25 bp, Homo sapiens
aatactggcactctcggcagcatac

SEQ ID NO: 46022 - DNA, 25 bp, Homo sapiens
caggagtgtggtgatggtggtcttc

SEQ ID NO: 46023 - DNA, 24 bp, Homo sapiens
atgccataacactcagcgagaccg

SEQ ID NO: 46024 - DNA, 24 bp, Homo sapiens
gacattgccgattacaaggagagc

SEQ ID NO: 46025 - DNA, 23 bp, Homo sapiens
ggcagcatacggcgaagcagagg

SEQ ID NO: 46026 - DNA, 25 bp, Homo sapiens
caggagtgtggtgatggtggtcttc

SEQ ID NO: 46027 - DNA, 23 bp, Homo sapiens
tcagtgaggagcagcacagccat

SEQ ID NO: 46028 - DNA, 23 bp, Homo sapiens
cactcagccataccttccaccgc

SEQ ID NO: 46029 - DNA, 25 bp, Homo sapiens
cagcaagaggtccagcaactgtctc

SEQ ID NO: 46030 - DNA, 24 bp, Homo sapiens
gattataacggctgggttctttat

SEQ ID NO: 46031 - DNA, 24 bp, Homo sapiens
tgattataacggctgggttcttta

SEQ ID NO: 46032 - DNA, 24 bp, Homo sapiens
ctgattataacggctgggttcttt

SEQ ID NO: 46033 - DNA, 24 bp, Homo sapiens
atattgtaaaggtatgtttagtaa

SEQ ID NO: 46034 - DNA, 24 bp, Homo sapiens
catattgtaaaggtatgtttagta

SEQ ID NO: 46035 - DNA, 24 bp, Homo sapiens
ccatattgtaaaggtatgtttagt

SEQ ID NO: 46036 - DNA, 25 bp, Homo sapiens
aacagaagtcaatgaatgccagtca

SEQ ID NO: 46037 - DNA, 23 bp, Homo sapiens
atggtgtggctggctatcgttgc

SEQ ID NO: 46038 - DNA, 24 bp, Homo sapiens
ccatcaggttacacaggtcagcgg

SEQ ID NO: 46039 - DNA, 25 bp, Homo sapiens
ttgttgttgttgttgttgttgttgt

SEQ ID NO: 46040 - DNA, 25 bp, Homo sapiens
aggcgtctctgtacgttatcccatt

SEQ ID NO: 46041 - DNA, 25 bp, Homo sapiens
gctactttatcaaactgtccagtca

SEQ ID NO: 46042 - DNA, 25 bp, Homo sapiens
tgaggaacccgattctgagacacac

SEQ ID NO: 46043 - DNA, 23 bp, Homo sapiens
gaggaggcggtgcggctgttctt

SEQ ID NO: 46044 - DNA, 23 bp, Homo sapiens
gcggtactggcaactcctcacct

SEQ ID NO: 46045 - DNA, 24 bp, Homo sapiens
ttaaattttaggtgtatttttgta

SEQ ID NO: 46046 - DNA, 24 bp, Homo sapiens
tttaaattttaggtgtatttttgt

SEQ ID NO: 46047 - DNA, 24 bp, Homo sapiens
ttttaaattttaggtgtatttttg

SEQ ID NO: 46048 - DNA, 24 bp, Homo sapiens
taaagaaacagggagaagagaagg

SEQ ID NO: 46049 - DNA, 24 bp, Homo sapiens
ctaaagaaacagggagaagagaag

SEQ ID NO: 46050 - DNA, 24 bp, Homo sapiens
cctaaagaaacagggagaagagaa

SEQ ID NO: 46051 - DNA, 25 bp, Homo sapiens
gaccaaccagaaggctcagacatct

SEQ ID NO: 46052 - DNA, 24 bp, Homo sapiens
cgtcgcagagaacttagaaggcaa

SEQ ID NO: 46053 - DNA, 25 bp, Homo sapiens
atgacgatgatgaagaggaggcagc

SEQ ID NO: 46054 - DNA, 25 bp, Homo sapiens
acagaagttaagtcgcagaatggag

SEQ ID NO: 46055 - DNA, 23 bp, Homo sapiens
cgtggacaccaaggaggctgagg

SEQ ID NO: 46056 - DNA, 25 bp, Homo sapiens
ggaggaggaagagcagaggaggaag

SEQ ID NO: 46057 - DNA, 24 bp, Homo sapiens
ctgtgctgcttgccctgttgatgg

SEQ ID NO: 46058 - DNA, 24 bp, Homo sapiens
tctccaccacagcccaccagtgac

SEQ ID NO: 46059 - DNA, 24 bp, Homo sapiens
tttgaggccatataaagtcacctg

SEQ ID NO: 46060 - DNA, 23 bp, Homo sapiens
ggtgacttcgactgggaggagct

SEQ ID NO: 46061 - DNA, 23 bp, Homo sapiens
gacccacagcctcctcctcaccc

SEQ ID NO: 46062 - DNA, 23 bp, Homo sapiens
tcttcttgggatgttgcaggcgg

SEQ ID NO: 46063 - DNA, 24 bp, Homo sapiens
gacaccgaaagaaagaacattgga

SEQ ID NO: 46064 - DNA, 24 bp, Homo sapiens
agacaccgaaagaaagaacattgg

SEQ ID NO: 46065 - DNA, 24 bp, Homo sapiens
aagacaccgaaagaaagaacattg

SEQ ID NO: 46066 - DNA, 24 bp, Homo sapiens
aacatcaaaagatatcacttgttc

SEQ ID NO: 46067 - DNA, 24 bp, Homo sapiens
aaacatcaaaagatatcacttgtt

SEQ ID NO: 46068 - DNA, 24 bp, Homo sapiens
caaacatcaaaagatatcacttgt

SEQ ID NO: 46069 - DNA, 24 bp, Homo sapiens
cctaggctcagggccatttctgag

SEQ ID NO: 46070 - DNA, 24 bp, Homo sapiens
tcctaggctcagggccatttctga

SEQ ID NO: 46071 - DNA, 24 bp, Homo sapiens
ctcctaggctcagggccatttctg

SEQ ID NO: 46072 - DNA, 24 bp, Homo sapiens
aaaaaaaaaaatccatccactgcc

SEQ ID NO: 46073 - DNA, 24 bp, Homo sapiens
aaaaaaaaaaaatccatccactgc

SEQ ID NO: 46074 - DNA, 24 bp, Homo sapiens
aaaaaaaaaaaaatccatccactg

SEQ ID NO: 46075 - DNA, 24 bp, Homo sapiens
ataatgaaaaggtatgataattca

SEQ ID NO: 46076 - DNA, 24 bp, Homo sapiens
tataatgaaaaggtatgataattc

SEQ ID NO: 46077 - DNA, 24 bp, Homo sapiens
ttataatgaaaaggtatgataatt

SEQ ID NO: 46078 - DNA, 25 bp, Homo sapiens
ttcctgcctcaccttccaattcgtt

SEQ ID NO: 46079 - DNA, 23 bp, Homo sapiens
tgccccaacctggcttgacaggc

SEQ ID NO: 46080 - DNA, 23 bp, Homo sapiens
tctgcaagtggctctcagcccct

SEQ ID NO: 46081 - DNA, 24 bp, Homo sapiens
acttcaaaagtgtaagtaaaatca

SEQ ID NO: 46082 - DNA, 24 bp, Homo sapiens
tacttcaaaagtgtaagtaaaatc

SEQ ID NO: 46083 - DNA, 24 bp, Homo sapiens
atacttcaaaagtgtaagtaaaat

SEQ ID NO: 46084 - DNA, 24 bp, Homo sapiens
ctgagaagcaggctgaacagtcca

SEQ ID NO: 46085 - DNA, 24 bp, Homo sapiens
gctgagaagcaggctgaacagtcc

SEQ ID NO: 46086 - DNA, 24 bp, Homo sapiens
agctgagaagcaggctgaacagtc

SEQ ID NO: 46087 - DNA, 24 bp, Homo sapiens
ccaccctcctcctccatcttctcc

SEQ ID NO: 46088 - DNA, 23 bp, Homo sapiens
acgagtctctttcccgctctggc

SEQ ID NO: 46089 - DNA, 23 bp, Homo sapiens
ggtgcggcggctccagaactcgg

SEQ ID NO: 46090 - DNA, 24 bp, Homo sapiens
gtgctttgcttgaagaaaaaatgc

SEQ ID NO: 46091 - DNA, 24 bp, Homo sapiens
agtgctttgcttgaagaaaaaatg

SEQ ID NO: 46092 - DNA, 24 bp, Homo sapiens
aagtgctttgcttgaagaaaaaat

SEQ ID NO: 46093 - DNA, 24 bp, Homo sapiens
aggatattcaggtaccatcaatac

SEQ ID NO: 46094 - DNA, 24 bp, Homo sapiens
aaggatattcaggtaccatcaata

SEQ ID NO: 46095 - DNA, 24 bp, Homo sapiens
gaaggatattcaggtaccatcaat

SEQ ID NO: 46096 - DNA, 24 bp, Homo sapiens
ttactaaaaaagtgagtaaaagct

SEQ ID NO: 46097 - DNA, 24 bp, Homo sapiens
cttactaaaaaagtgagtaaaagc

SEQ ID NO: 46098 - DNA, 24 bp, Homo sapiens
tcttactaaaaaagtgagtaaaag

SEQ ID NO: 46099 - DNA, 25 bp, Homo sapiens
tggaagcacttgtctaaggtcacgc

SEQ ID NO: 46100 - DNA, 24 bp, Homo sapiens
agtccaagtggtcaggctccagag

SEQ ID NO: 46101 - DNA, 24 bp, Homo sapiens
cgtggaggatggcaagtggtatgg

SEQ ID NO: 46102 - DNA, 24 bp, Homo sapiens
ggtagtctgttgtccttgcggtcg

SEQ ID NO: 46103 - DNA, 23 bp, Homo sapiens
gttgcgagaagagccatcagcca

SEQ ID NO: 46104 - DNA, 24 bp, Homo sapiens
agtctcactctgtcgtccaggctg

SEQ ID NO: 46105 - DNA, 23 bp, Homo sapiens
tgtcatgtgccacctgttcaccg

SEQ ID NO: 46106 - DNA, 23 bp, Homo sapiens
ccgaccttcaggaatggcagcct

SEQ ID NO: 46107 - DNA, 23 bp, Homo sapiens
aggctggagtacagtggcgtgat

SEQ ID NO: 46108 - DNA, 24 bp, Homo sapiens
tcatgtaaaaatgctgaaggatat

SEQ ID NO: 46109 - DNA, 24 bp, Homo sapiens
atcatgtaaaaatgctgaaggata

SEQ ID NO: 46110 - DNA, 24 bp, Homo sapiens
gatcatgtaaaaatgctgaaggat

SEQ ID NO: 46111 - DNA, 24 bp, Homo sapiens
ggtgttgctgtgggcgtctgatag

SEQ ID NO: 46112 - DNA, 25 bp, Homo sapiens
ccagtatctccgtgcttcagaatga

SEQ ID NO: 46113 - DNA, 24 bp, Homo sapiens
cgcctctcccgaaatgacatccag

SEQ ID NO: 46114 - DNA, 23 bp, Homo sapiens
gaggtctcgccatgttgctcaga

SEQ ID NO: 46115 - DNA, 25 bp, Homo sapiens
gcagatagcttgagccgaggagttc

SEQ ID NO: 46116 - DNA, 25 bp, Homo sapiens
cctttcaagtggctgggatgactac

SEQ ID NO: 46117 - DNA, 25 bp, Homo sapiens
gccaactgcatcatgttcgtcctct

SEQ ID NO: 46118 - DNA, 24 bp, Homo sapiens
ctctgttgctgctgctgctcttct

SEQ ID NO: 46119 - DNA, 23 bp, Homo sapiens
cgccttccaagccaggagaatct

SEQ ID NO: 46120 - DNA, 23 bp, Homo sapiens
cgccttccaagccaggagaatct

SEQ ID NO: 46121 - DNA, 24 bp, Homo sapiens
ctctgttgctgctgctgctcttct

SEQ ID NO: 46122 - DNA, 23 bp, Homo sapiens
cgtttcagggaggtgccaactgc

SEQ ID NO: 46123 - DNA, 24 bp, Homo sapiens
taataacaacagtaagtatatact

SEQ ID NO: 46124 - DNA, 24 bp, Homo sapiens
ctaataacaacagtaagtatatac

SEQ ID NO: 46125 - DNA, 24 bp, Homo sapiens
actaataacaacagtaagtatata

SEQ ID NO: 46126 - DNA, 24 bp, Homo sapiens
aaatccaacaggtatcttatagct

SEQ ID NO: 46127 - DNA, 24 bp, Homo sapiens
caaatccaacaggtatcttatagc

SEQ ID NO: 46128 - DNA, 24 bp, Homo sapiens
tcaaatccaacaggtatcttatag

SEQ ID NO: 46129 - DNA, 24 bp, Homo sapiens
ttcttaaaaagtgctccgtatctt

SEQ ID NO: 46130 - DNA, 24 bp, Homo sapiens
tttcttaaaaagtgctccgtatct

SEQ ID NO: 46131 - DNA, 24 bp, Homo sapiens
atttcttaaaaagtgctccgtatc

SEQ ID NO: 46132 - DNA, 24 bp, Homo sapiens
gccaggtcaactcacaggaggatt

SEQ ID NO: 46133 - DNA, 24 bp, Homo sapiens
ccactatcgcttcactgcctacgg

SEQ ID NO: 46134 - DNA, 23 bp, Homo sapiens
cctcagagccaccacttcagccg

SEQ ID NO: 46135 - DNA, 25 bp, Homo sapiens
aattactgtgatcctgaagttcgcc

SEQ ID NO: 46136 - DNA, 25 bp, Homo sapiens
gcacacagccactttcctagttccc

SEQ ID NO: 46137 - DNA, 25 bp, Homo sapiens
aggtggtccatccatcagtcagagg

SEQ ID NO: 46138 - DNA, 25 bp, Homo sapiens
tctgtgtcctcagtatcctgcctgg

SEQ ID NO: 46139 - DNA, 25 bp, Homo sapiens
taccgtgatgtgatgctggagacct

SEQ ID NO: 46140 - DNA, 25 bp, Homo sapiens
gattgccaagcctgaggtcatctcc

SEQ ID NO: 46141 - DNA, 24 bp, Homo sapiens
tgccaccaccatgtaagaagtgcc

SEQ ID NO: 46142 - DNA, 23 bp, Homo sapiens
ctcccaccatgaacctgaggcct

SEQ ID NO: 46143 - DNA, 24 bp, Homo sapiens
ggagatgaaggagagtgtgaaccg

SEQ ID NO: 46144 - DNA, 23 bp, Homo sapiens
aagacagccgccagcactatgag

SEQ ID NO: 46145 - DNA, 23 bp, Homo sapiens
gcggcacttgaactctgacctgg

SEQ ID NO: 46146 - DNA, 25 bp, Homo sapiens
cacggttctgcttccagtccaagag

SEQ ID NO: 46147 - DNA, 23 bp, Homo sapiens
aggcaggcagaccagaccttcat

SEQ ID NO: 46148 - DNA, 25 bp, Homo sapiens
gctaggcaggtgttcagatgaggtg

SEQ ID NO: 46149 - DNA, 23 bp, Homo sapiens
aggcaggcagaccagaccttcat

SEQ ID NO: 46150 - DNA, 25 bp, Homo sapiens
gctaggcaggtgttcagatgaggtg

SEQ ID NO: 46151 - DNA, 23 bp, Homo sapiens
tcaccaacgagaggcggcttcag

SEQ ID NO: 46152 - DNA, 25 bp, Homo sapiens
tgttcctggtggctcaatctctagt

SEQ ID NO: 46153 - DNA, 25 bp, Homo sapiens
cattgcctgagatggtgttctgtaa

SEQ ID NO: 46154 - DNA, 25 bp, Homo sapiens
acttcaaggtgttgcttatctccat

SEQ ID NO: 46155 - DNA, 23 bp, Homo sapiens
ctagcagtaaagatgggggagcc

SEQ ID NO: 46156 - DNA, 23 bp, Homo sapiens
cccatcccctccagcccccaagg

SEQ ID NO: 46157 - DNA, 24 bp, Homo sapiens
agaaacaaaaagtaatgacccgag

SEQ ID NO: 46158 - DNA, 24 bp, Homo sapiens
gagaaacaaaaagtaatgacccga

SEQ ID NO: 46159 - DNA, 24 bp, Homo sapiens
tgagaaacaaaaagtaatgacccg

SEQ ID NO: 46160 - DNA, 24 bp, Homo sapiens
ggtaaaagaaggtatggatataat

SEQ ID NO: 46161 - DNA, 24 bp, Homo sapiens
tggtaaaagaaggtatggatataa

SEQ ID NO: 46162 - DNA, 24 bp, Homo sapiens
atggtaaaagaaggtatggatata

SEQ ID NO: 46163 - DNA, 24 bp, Homo sapiens
gttacaaatatgtaagtgaattcc

SEQ ID NO: 46164 - DNA, 24 bp, Homo sapiens
agttacaaatatgtaagtgaattc

SEQ ID NO: 46165 - DNA, 24 bp, Homo sapiens
aagttacaaatatgtaagtgaatt

SEQ ID NO: 46166 - DNA, 23 bp, Homo sapiens
tctatgaggctgctgacaagtgg

SEQ ID NO: 46167 - DNA, 24 bp, Homo sapiens
gccagaagccgaatctcgctgatt

SEQ ID NO: 46168 - DNA, 23 bp, Homo sapiens
tgtatggcgtgctgcgtgtgatg

SEQ ID NO: 46169 - DNA, 24 bp, Homo sapiens
gctttaatcagaggaagaacgatg

SEQ ID NO: 46170 - DNA, 24 bp, Homo sapiens
tgctttaatcagaggaagaacgat

SEQ ID NO: 46171 - DNA, 24 bp, Homo sapiens
atgctttaatcagaggaagaacga

SEQ ID NO: 46172 - DNA, 23 bp, Homo sapiens
gcacaaggagccgaactgaccaa

SEQ ID NO: 46173 - DNA, 25 bp, Homo sapiens
cggtaattgaaggactggagacatt

SEQ ID NO: 46174 - DNA, 25 bp, Homo sapiens
gcaccttgactatcttggatgacac

SEQ ID NO: 46175 - DNA, 24 bp, Homo sapiens
cgtgactgacgacgaagttatacg

SEQ ID NO: 46176 - DNA, 24 bp, Homo sapiens
ccgtgactgacgacgaagttatac

SEQ ID NO: 46177 - DNA, 24 bp, Homo sapiens
gccgtgactgacgacgaagttata

SEQ ID NO: 46178 - DNA, 24 bp, Homo sapiens
acctacctgtccattgactccgcc

SEQ ID NO: 46179 - DNA, 23 bp, Homo sapiens
gcttcctggctgtgctgaccgaa

SEQ ID NO: 46180 - DNA, 23 bp, Homo sapiens
ttaccgcaaccaccgccaccagt

SEQ ID NO: 46181 - DNA, 23 bp, Homo sapiens
cgtgtgcctggtgctgctggtgg

SEQ ID NO: 46182 - DNA, 23 bp, Homo sapiens
ggacattcgcaggacgcagaacg

SEQ ID NO: 46183 - DNA, 23 bp, Homo sapiens
atggtcttcggaggggtggtgcc

SEQ ID NO: 46184 - DNA, 24 bp, Homo sapiens
cctgaccatgctgctgatgctgaa

SEQ ID NO: 46185 - DNA, 25 bp, Homo sapiens
caaggatgaagaagtcaaggttgcc

SEQ ID NO: 46186 - DNA, 24 bp, Homo sapiens
agtggagcagcttctcggactacg

SEQ ID NO: 46187 - DNA, 24 bp, Homo sapiens
gattgtcaaaagagctggaggtta

SEQ ID NO: 46188 - DNA, 24 bp, Homo sapiens
agattgtcaaaagagctggaggtt

SEQ ID NO: 46189 - DNA, 24 bp, Homo sapiens
cagattgtcaaaagagctggaggt

SEQ ID NO: 46190 - DNA, 23 bp, Homo sapiens
ggcagcctattgtctttctccgc

SEQ ID NO: 46191 - DNA, 23 bp, Homo sapiens
ggtgaggagctgtctcggctcgg

SEQ ID NO: 46192 - DNA, 23 bp, Homo sapiens
gcagccgctgctgccgccgccgg

SEQ ID NO: 46193 - DNA, 24 bp, Homo sapiens
tgggatggctcaaaggagtcagga

SEQ ID NO: 46194 - DNA, 24 bp, Homo sapiens
ccagagcatctcggagttcagact

SEQ ID NO: 46195 - DNA, 24 bp, Homo sapiens
tggaggatggaggacagcgagaag

SEQ ID NO: 46196 - DNA, 24 bp, Homo sapiens
taaccccaatgcattttcctacat

SEQ ID NO: 46197 - DNA, 24 bp, Homo sapiens
ttaaccccaatgcattttcctaca

SEQ ID NO: 46198 - DNA, 24 bp, Homo sapiens
tttaaccccaatgcattttcctac

SEQ ID NO: 46199 - DNA, 25 bp, Homo sapiens
tgggattaggactacggcataaagc

SEQ ID NO: 46200 - DNA, 23 bp, Homo sapiens
tctgtggctgcttgttggtgtgg

SEQ ID NO: 46201 - DNA, 25 bp, Homo sapiens
tcgggctgaatatgctatttggtcc

SEQ ID NO: 46202 - DNA, 24 bp, Homo sapiens
ccgtcaggtatggaagaagcagtc

SEQ ID NO: 46203 - DNA, 24 bp, Homo sapiens
cagtggctcacacctgtaatctca

SEQ ID NO: 46204 - DNA, 23 bp, Homo sapiens
gcgtctcctgtcaatccgtcctg

SEQ ID NO: 46205 - DNA, 23 bp, Homo sapiens
cagaggagctgcgtggctacgac

SEQ ID NO: 46206 - DNA, 23 bp, Homo sapiens
cggccacagcagcagcgccacga

SEQ ID NO: 46207 - DNA, 23 bp, Homo sapiens
cacccggctgcctggagtcgagg

SEQ ID NO: 46208 - DNA, 23 bp, Homo sapiens
gtccctccctctccccctgcctc

SEQ ID NO: 46209 - DNA, 23 bp, Homo sapiens
tgcaggccccacgccgccccccg

SEQ ID NO: 46210 - DNA, 23 bp, Homo sapiens
ggtccggatacctccgtctcggg

SEQ ID NO: 46211 - DNA, 24 bp, Homo sapiens
cttctacctttgttccaatttatt

SEQ ID NO: 46212 - DNA, 24 bp, Homo sapiens
tcttctacctttgttccaatttat

SEQ ID NO: 46213 - DNA, 24 bp, Homo sapiens
ttcttctacctttgttccaattta

SEQ ID NO: 46214 - DNA, 24 bp, Homo sapiens
acatctttaaggtcagaagaaaag

SEQ ID NO: 46215 - DNA, 24 bp, Homo sapiens
aacatctttaaggtcagaagaaaa

SEQ ID NO: 46216 - DNA, 24 bp, Homo sapiens
caacatctttaaggtcagaagaaa

SEQ ID NO: 46217 - DNA, 24 bp, Homo sapiens
ggaagcttttgggaatgcgtgtac

SEQ ID NO: 46218 - DNA, 24 bp, Homo sapiens
tggaagcttttgggaatgcgtgta

SEQ ID NO: 46219 - DNA, 24 bp, Homo sapiens
atggaagcttttgggaatgcgtgt

SEQ ID NO: 46220 - DNA, 24 bp, Homo sapiens
gagaccatccatatcagtgctgct

SEQ ID NO: 46221 - DNA, 23 bp, Homo sapiens
ctctggccccgacagcccatatc

SEQ ID NO: 46222 - DNA, 25 bp, Homo sapiens
acaagttactaagaaggcttcatcc

SEQ ID NO: 46223 - DNA, 24 bp, Homo sapiens
tcagaataaattaaaagaattagt

SEQ ID NO: 46224 - DNA, 24 bp, Homo sapiens
ttcagaataaattaaaagaattag

SEQ ID NO: 46225 - DNA, 24 bp, Homo sapiens
tttcagaataaattaaaagaatta

SEQ ID NO: 46226 - DNA, 24 bp, Homo sapiens
ttgatccagaagaaccgccgagtg

SEQ ID NO: 46227 - DNA, 23 bp, Homo sapiens
cttcagcaccatcagcagcagca

SEQ ID NO: 46228 - DNA, 23 bp, Homo sapiens
attccagccgaacttccatccgc

SEQ ID NO: 46229 - DNA, 24 bp, Homo sapiens
tgctgtgggctgctgaatgaagtc

SEQ ID NO: 46230 - DNA, 23 bp, Homo sapiens
tccacctacccaccagcagctac

SEQ ID NO: 46231 - DNA, 25 bp, Homo sapiens
gcccaacatagtttgtaaagcctgt

SEQ ID NO: 46232 - DNA, 24 bp, Homo sapiens
tgctgtgggctgctgaatgaagtc

SEQ ID NO: 46233 - DNA, 25 bp, Homo sapiens
gcccaacatagtttgtaaagcctgt

SEQ ID NO: 46234 - DNA, 25 bp, Homo sapiens
gttaatgcgactgaaggtgaaggac

SEQ ID NO: 46235 - DNA, 24 bp, Homo sapiens
tcagcagagcttgccagtgaagca

SEQ ID NO: 46236 - DNA, 24 bp, Homo sapiens
ttcagcagagcttgccagtgaagc

SEQ ID NO: 46237 - DNA, 24 bp, Homo sapiens
cttcagcagagcttgccagtgaag

SEQ ID NO: 46238 - DNA, 24 bp, Homo sapiens
gacagaagatgaggtctaccaggc

SEQ ID NO: 46239 - DNA, 23 bp, Homo sapiens
ggactgaggaaccaggcacagga

SEQ ID NO: 46240 - DNA, 23 bp, Homo sapiens
cggctgctgctgctgctgtctcc

SEQ ID NO: 46241 - DNA, 23 bp, Homo sapiens
ggtggtggcagcaacagagggtt

SEQ ID NO: 46242 - DNA, 23 bp, Homo sapiens
ggctcctgaccctgactctgctg

SEQ ID NO: 46243 - DNA, 23 bp, Homo sapiens
ctggagctgtgtctactctgcgg

SEQ ID NO: 46244 - DNA, 23 bp, Homo sapiens
ccttcacacagacatcctcgggc

SEQ ID NO: 46245 - DNA, 23 bp, Homo sapiens
cctcagccagttgtatccacagc

SEQ ID NO: 46246 - DNA, 23 bp, Homo sapiens
ggctcctgaccctgactctgctg

SEQ ID NO: 46247 - DNA, 24 bp, Homo sapiens
atacaccctcagtacccaaaacgc

SEQ ID NO: 46248 - DNA, 24 bp, Homo sapiens
gatacaccctcagtacccaaaacg

SEQ ID NO: 46249 - DNA, 24 bp, Homo sapiens
agatacaccctcagtacccaaaac

SEQ ID NO: 46250 - DNA, 24 bp, Homo sapiens
ccaacaataaggggaaattctata

SEQ ID NO: 46251 - DNA, 24 bp, Homo sapiens
cccaacaataaggggaaattctat

SEQ ID NO: 46252 - DNA, 24 bp, Homo sapiens
acccaacaataaggggaaattcta

SEQ ID NO: 46253 - DNA, 24 bp, Homo sapiens
tgacaataaggtttaaccctgatg

SEQ ID NO: 46254 - DNA, 24 bp, Homo sapiens
atgacaataaggtttaaccctgat

SEQ ID NO: 46255 - DNA, 24 bp, Homo sapiens
tatgacaataaggtttaaccctga

SEQ ID NO: 46256 - DNA, 24 bp, Homo sapiens
tcttataaaaggtagctaaaaaag

SEQ ID NO: 46257 - DNA, 24 bp, Homo sapiens
atcttataaaaggtagctaaaaaa

SEQ ID NO: 46258 - DNA, 24 bp, Homo sapiens
tatcttataaaaggtagctaaaaa

SEQ ID NO: 46259 - DNA, 24 bp, Homo sapiens
taaaaaaggaaatatcacctggag

SEQ ID NO: 46260 - DNA, 24 bp, Homo sapiens
gtaaaaaaggaaatatcacctgga

SEQ ID NO: 46261 - DNA, 24 bp, Homo sapiens
cgtaaaaaaggaaatatcacctgg

SEQ ID NO: 46262 - DNA, 24 bp, Homo sapiens
tttaattttagatggaagaagaac

SEQ ID NO: 46263 - DNA, 24 bp, Homo sapiens
ttttaattttagatggaagaagaa

SEQ ID NO: 46264 - DNA, 24 bp, Homo sapiens
cttttaattttagatggaagaaga

SEQ ID NO: 46265 - DNA, 24 bp, Homo sapiens
ttttattcaaggttgaaattttaa

SEQ ID NO: 46266 - DNA, 24 bp, Homo sapiens
tttttattcaaggttgaaatttta

SEQ ID NO: 46267 - DNA, 24 bp, Homo sapiens
ctttttattcaaggttgaaatttt

SEQ ID NO: 46268 - DNA, 24 bp, Homo sapiens
aagtccagaagaatacaaatcata

SEQ ID NO: 46269 - DNA, 24 bp, Homo sapiens
taagtccagaagaatacaaatcat

SEQ ID NO: 46270 - DNA, 24 bp, Homo sapiens
ataagtccagaagaatacaaatca

SEQ ID NO: 46271 - DNA, 24 bp, Homo sapiens
atttccaaaaaatataaacaacat

SEQ ID NO: 46272 - DNA, 24 bp, Homo sapiens
gatttccaaaaaatataaacaaca

SEQ ID NO: 46273 - DNA, 24 bp, Homo sapiens
agatttccaaaaaatataaacaac

SEQ ID NO: 46274 - DNA, 24 bp, Homo sapiens
taatgagcagcaacaggagccagc

SEQ ID NO: 46275 - DNA, 25 bp, Homo sapiens
aagacctcgatgttgcagtgattgt

SEQ ID NO: 46276 - DNA, 25 bp, Homo sapiens
agctcatgtggatttagcacttcac

SEQ ID NO: 46277 - DNA, 24 bp, Homo sapiens
acagaatcaaatttatcatctgga

SEQ ID NO: 46278 - DNA, 24 bp, Homo sapiens
tacagaatcaaatttatcatctgg

SEQ ID NO: 46279 - DNA, 24 bp, Homo sapiens
atacagaatcaaatttatcatctg

SEQ ID NO: 46280 - DNA, 24 bp, Homo sapiens
agctacctcaaatacctctaacct

SEQ ID NO: 46281 - DNA, 24 bp, Homo sapiens
cagctacctcaaatacctctaacc

SEQ ID NO: 46282 - DNA, 24 bp, Homo sapiens
acagctacctcaaatacctctaac

SEQ ID NO: 46283 - DNA, 24 bp, Homo sapiens
gccaccacaacagcagcaacctct

SEQ ID NO: 46284 - DNA, 24 bp, Homo sapiens
agggaggctctgtctttggtggta

SEQ ID NO: 46285 - DNA, 24 bp, Homo sapiens
cagtggaagtgtctttggtgccgc

SEQ ID NO: 46286 - DNA, 24 bp, Homo sapiens
ttcatcctcagtatttttcagtgc

SEQ ID NO: 46287 - DNA, 24 bp, Homo sapiens
tttcatcctcagtatttttcagtg

SEQ ID NO: 46288 - DNA, 24 bp, Homo sapiens
atttcatcctcagtatttttcagt

SEQ ID NO: 46289 - DNA, 24 bp, Homo sapiens
cgtgaactcaggatcccatccagc

SEQ ID NO: 46290 - DNA, 24 bp, Homo sapiens
ccgtgaactcaggatcccatccag

SEQ ID NO: 46291 - DNA, 24 bp, Homo sapiens
tccgtgaactcaggatcccatcca

SEQ ID NO: 46292 - DNA, 24 bp, Homo sapiens
atgtttatcagggatctgtttata

SEQ ID NO: 46293 - DNA, 24 bp, Homo sapiens
tatgtttatcagggatctgtttat

SEQ ID NO: 46294 - DNA, 24 bp, Homo sapiens
gtatgtttatcagggatctgttta

SEQ ID NO: 46295 - DNA, 23 bp, Homo sapiens
cagtgagcgtgtggaccattgaa

SEQ ID NO: 46296 - DNA, 23 bp, Homo sapiens
acagcctggaatggatgtgaacc

SEQ ID NO: 46297 - DNA, 24 bp, Homo sapiens
agttactgtggcacctacctggct

SEQ ID NO: 46298 - DNA, 25 bp, Homo sapiens
tgctggcttctggaattgatggctt

SEQ ID NO: 46299 - DNA, 25 bp, Homo sapiens
gttgctgattcaaacagacaaggga

SEQ ID NO: 46300 - DNA, 24 bp, Homo sapiens
gtggctggaggattgtgcttgtgt

SEQ ID NO: 46301 - DNA, 24 bp, Homo sapiens
tattggacaggagatgtcgccaca

SEQ ID NO: 46302 - DNA, 24 bp, Homo sapiens
gtattggacaggagatgtcgccac

SEQ ID NO: 46303 - DNA, 24 bp, Homo sapiens
ggtattggacaggagatgtcgcca

SEQ ID NO: 46304 - DNA, 25 bp, Homo sapiens
aggctatggaactggagtatgtcct

SEQ ID NO: 46305 - DNA, 23 bp, Homo sapiens
cctggatgaagtggtggcggctg

SEQ ID NO: 46306 - DNA, 25 bp, Homo sapiens
ccaatacaaccagcagttcctgtcc

SEQ ID NO: 46307 - DNA, 24 bp, Homo sapiens
aggggaaagcagtgttctggcact

SEQ ID NO: 46308 - DNA, 24 bp, Homo sapiens
gaggggaaagcagtgttctggcac

SEQ ID NO: 46309 - DNA, 24 bp, Homo sapiens
agaggggaaagcagtgttctggca

SEQ ID NO: 46310 - DNA, 25 bp, Homo sapiens
tggtggattcttggtctcactgact

SEQ ID NO: 46311 - DNA, 25 bp, Homo sapiens
gcagttgtgtcctcatcatcaatct

SEQ ID NO: 46312 - DNA, 25 bp, Homo sapiens
tgctgaaccaaatgtgtgaaaggct

SEQ ID NO: 46313 - DNA, 24 bp, Homo sapiens
tgctgagcttaacgtgcctatcga

SEQ ID NO: 46314 - DNA, 23 bp, Homo sapiens
tgctcctgcctgccctgagcccg

SEQ ID NO: 46315 - DNA, 23 bp, Homo sapiens
agggcatggattaccgggactgg

SEQ ID NO: 46316 - DNA, 23 bp, Homo sapiens
gctgcctcttgcttgaccttggt

SEQ ID NO: 46317 - DNA, 25 bp, Homo sapiens
agaatagcaaccttgagactggcat

SEQ ID NO: 46318 - DNA, 23 bp, Homo sapiens
gctcaagtgatcctcctgcctca

SEQ ID NO: 46319 - DNA, 24 bp, Homo sapiens
tggacctggactctgagatgcctg

SEQ ID NO: 46320 - DNA, 23 bp, Homo sapiens
gtctcccaggacgcatgaaggtg

SEQ ID NO: 46321 - DNA, 23 bp, Homo sapiens
tgcccagccagcctgaacatctg

SEQ ID NO: 46322 - DNA, 24 bp, Homo sapiens
ggcgttctctggtctacgagccag

SEQ ID NO: 46323 - DNA, 24 bp, Homo sapiens
gggcgttctctggtctacgagcca

SEQ ID NO: 46324 - DNA, 24 bp, Homo sapiens
cgggcgttctctggtctacgagcc

SEQ ID NO: 46325 - DNA, 23 bp, Homo sapiens
tggctgctggtgctggtatcctc

SEQ ID NO: 46326 - DNA, 23 bp, Homo sapiens
ggcttcttggaggcattgtggct

SEQ ID NO: 46327 - DNA, 24 bp, Homo sapiens
ccctggtttgaagtctctgacccg

SEQ ID NO: 46328 - DNA, 24 bp, Homo sapiens
aatttcaacatttatcatcgctgt

SEQ ID NO: 46329 - DNA, 24 bp, Homo sapiens
taatttcaacatttatcatcgctg

SEQ ID NO: 46330 - DNA, 24 bp, Homo sapiens
ataatttcaacatttatcatcgct

SEQ ID NO: 46331 - DNA, 24 bp, Homo sapiens
aagaaagacaggtttgtatgacac

SEQ ID NO: 46332 - DNA, 24 bp, Homo sapiens
taagaaagacaggtttgtatgaca

SEQ ID NO: 46333 - DNA, 24 bp, Homo sapiens
ataagaaagacaggtttgtatgac

SEQ ID NO: 46334 - DNA, 24 bp, Homo sapiens
caatatttgaggtttgctttttac

SEQ ID NO: 46335 - DNA, 24 bp, Homo sapiens
acaatatttgaggtttgcttttta

SEQ ID NO: 46336 - DNA, 24 bp, Homo sapiens
aacaatatttgaggtttgcttttt

SEQ ID NO: 46337 - DNA, 24 bp, Homo sapiens
accagaaatgagtaagtattttcc

SEQ ID NO: 46338 - DNA, 24 bp, Homo sapiens
aaccagaaatgagtaagtattttc

SEQ ID NO: 46339 - DNA, 24 bp, Homo sapiens
gaaccagaaatgagtaagtatttt

SEQ ID NO: 46340 - DNA, 23 bp, Homo sapiens
catccacacggctgggctggtag

SEQ ID NO: 46341 - DNA, 23 bp, Homo sapiens
ccatccatgaggtcaacgtgcag

SEQ ID NO: 46342 - DNA, 23 bp, Homo sapiens
cggaacgtgatcgaggcttgtgt

SEQ ID NO: 46343 - DNA, 24 bp, Homo sapiens
agctcatggaggtactgtcatctc

SEQ ID NO: 46344 - DNA, 24 bp, Homo sapiens
gagctcatggaggtactgtcatct

SEQ ID NO: 46345 - DNA, 24 bp, Homo sapiens
tgagctcatggaggtactgtcatc

SEQ ID NO: 46346 - DNA, 24 bp, Homo sapiens
ctacagaaaaagtaagttttaagt

SEQ ID NO: 46347 - DNA, 24 bp, Homo sapiens
actacagaaaaagtaagttttaag

SEQ ID NO: 46348 - DNA, 24 bp, Homo sapiens
tactacagaaaaagtaagttttaa

SEQ ID NO: 46349 - DNA, 24 bp, Homo sapiens
gatacgagatggagataataactt

SEQ ID NO: 46350 - DNA, 24 bp, Homo sapiens
tgatacgagatggagataataact

SEQ ID NO: 46351 - DNA, 24 bp, Homo sapiens
gtgatacgagatggagataataac

SEQ ID NO: 46352 - DNA, 24 bp, Homo sapiens
ccgcctaattggagcttactgtgg

SEQ ID NO: 46353 - DNA, 24 bp, Homo sapiens
ggtgcttgtggtggcttcctgagg

SEQ ID NO: 46354 - DNA, 24 bp, Homo sapiens
ccgactctaccgtggaactcaaca

SEQ ID NO: 46355 - DNA, 24 bp, Homo sapiens
tcagttacagcattcagagaaaat

SEQ ID NO: 46356 - DNA, 24 bp, Homo sapiens
ctcagttacagcattcagagaaaa

SEQ ID NO: 46357 - DNA, 24 bp, Homo sapiens
gctcagttacagcattcagagaaa

SEQ ID NO: 46358 - DNA, 24 bp, Homo sapiens
gtgacggctggcatcatcattgtt

SEQ ID NO: 46359 - DNA, 25 bp, Homo sapiens
gcagagaaggcaggaccatgacatc

SEQ ID NO: 46360 - DNA, 23 bp, Homo sapiens
gggtctgggtggctactggaggg

SEQ ID NO: 46361 - DNA, 23 bp, Homo sapiens
gcttgccaatgaggaagacaacc

SEQ ID NO: 46362 - DNA, 23 bp, Homo sapiens
aagcagcagcgaggagagcacag

SEQ ID NO: 46363 - DNA, 23 bp, Homo sapiens
gaagcctccacagaagccagagc

SEQ ID NO: 46364 - DNA, 24 bp, Homo sapiens
ttttattgcaggaagtattactta

SEQ ID NO: 46365 - DNA, 24 bp, Homo sapiens
cttttattgcaggaagtattactt

SEQ ID NO: 46366 - DNA, 24 bp, Homo sapiens
tcttttattgcaggaagtattact

SEQ ID NO: 46367 - DNA, 24 bp, Homo sapiens
gctctatttcagtaagtaatttat

SEQ ID NO: 46368 - DNA, 24 bp, Homo sapiens
agctctatttcagtaagtaattta

SEQ ID NO: 46369 - DNA, 24 bp, Homo sapiens
aagctctatttcagtaagtaattt

SEQ ID NO: 46370 - DNA, 23 bp, Homo sapiens
gagaacggatggagggaagcagc

SEQ ID NO: 46371 - DNA, 23 bp, Homo sapiens
tctgtggctgctgctgatctgga

SEQ ID NO: 46372 - DNA, 23 bp, Homo sapiens
tcagactaggagcttgcctgcca

SEQ ID NO: 46373 - DNA, 24 bp, Homo sapiens
tgaggcaggagattgttgagcacg

SEQ ID NO: 46374 - DNA, 23 bp, Homo sapiens
tgcggactcctcagagaactggc

SEQ ID NO: 46375 - DNA, 23 bp, Homo sapiens
gatgaccctccgtgacctcccga

SEQ ID NO: 46376 - DNA, 24 bp, Homo sapiens
aagttaataagcaagataaagccg

SEQ ID NO: 46377 - DNA, 24 bp, Homo sapiens
aaagttaataagcaagataaagcc

SEQ ID NO: 46378 - DNA, 24 bp, Homo sapiens
caaagttaataagcaagataaagc

SEQ ID NO: 46379 - DNA, 24 bp, Homo sapiens
ggaggaggtggtggtgctattgga

SEQ ID NO: 46380 - DNA, 24 bp, Homo sapiens
ctggagcagttcctgaccatcctg

SEQ ID NO: 46381 - DNA, 23 bp, Homo sapiens
cgcttccgaggcttccgctaccc

SEQ ID NO: 46382 - DNA, 24 bp, Homo sapiens
atatcttataggtgaagtgccagc

SEQ ID NO: 46383 - DNA, 24 bp, Homo sapiens
aatatcttataggtgaagtgccag

SEQ ID NO: 46384 - DNA, 24 bp, Homo sapiens
aaatatcttataggtgaagtgcca

SEQ ID NO: 46385 - DNA, 24 bp, Homo sapiens
ttttcctaaagccagaattcacaa

SEQ ID NO: 46386 - DNA, 24 bp, Homo sapiens
gttttcctaaagccagaattcaca

SEQ ID NO: 46387 - DNA, 24 bp, Homo sapiens
tgttttcctaaagccagaattcac

SEQ ID NO: 46388 - DNA, 24 bp, Homo sapiens
tgaaaatcaaggtatgacttttag

SEQ ID NO: 46389 - DNA, 24 bp, Homo sapiens
ttgaaaatcaaggtatgactttta

SEQ ID NO: 46390 - DNA, 24 bp, Homo sapiens
attgaaaatcaaggtatgactttt

SEQ ID NO: 46391 - DNA, 24 bp, Homo sapiens
gaatggaaaaggaaaagagaacac

SEQ ID NO: 46392 - DNA, 24 bp, Homo sapiens
agaatggaaaaggaaaagagaaca

SEQ ID NO: 46393 - DNA, 24 bp, Homo sapiens
gagaatggaaaaggaaaagagaac

SEQ ID NO: 46394 - DNA, 23 bp, Homo sapiens
ctatgcccgcccagcccagccca

SEQ ID NO: 46395 - DNA, 23 bp, Homo sapiens
gcgcggtgccgagcgggcccccg

SEQ ID NO: 46396 - DNA, 24 bp, Homo sapiens
ggttctgagtgctccgaggaatgg

SEQ ID NO: 46397 - DNA, 23 bp, Homo sapiens
gctgtgccaagtatcctccctcc

SEQ ID NO: 46398 - DNA, 23 bp, Homo sapiens
gtgggtgtggcgagtctgctctg

SEQ ID NO: 46399 - DNA, 25 bp, Homo sapiens
aggaacatctacgacaagtacggct

SEQ ID NO: 46400 - DNA, 25 bp, Homo sapiens
cgtgaacacctacttcgtgctgtcc

SEQ ID NO: 46401 - DNA, 23 bp, Homo sapiens
gctgctactgctgctgctgtctg

SEQ ID NO: 46402 - DNA, 24 bp, Homo sapiens
tgtgcagggagggatgccctgtgt

SEQ ID NO: 46403 - DNA, 24 bp, Homo sapiens
ctgtgcagggagggatgccctgtg

SEQ ID NO: 46404 - DNA, 24 bp, Homo sapiens
cctgtgcagggagggatgccctgt

SEQ ID NO: 46405 - DNA, 23 bp, Homo sapiens
cgacctctgctgctttgctcaca

SEQ ID NO: 46406 - DNA, 23 bp, Homo sapiens
gaagcgggcgaggagtgtgactg

SEQ ID NO: 46407 - DNA, 23 bp, Homo sapiens
gtgagcacggaccactcggagct

SEQ ID NO: 46408 - DNA, 25 bp, Homo sapiens
gtggatggaggagtgagtgacaacg

SEQ ID NO: 46409 - DNA, 25 bp, Homo sapiens
tctgccctaaagtcaagtccacgaa

SEQ ID NO: 46410 - DNA, 25 bp, Homo sapiens
atcaccaagctcagtctacgcctct

SEQ ID NO: 46411 - DNA, 24 bp, Homo sapiens
tttggaatctaaaaaggctaacat

SEQ ID NO: 46412 - DNA, 24 bp, Homo sapiens
ttttggaatctaaaaaggctaaca

SEQ ID NO: 46413 - DNA, 24 bp, Homo sapiens
attttggaatctaaaaaggctaac

SEQ ID NO: 46414 - DNA, 24 bp, Homo sapiens
ctggaaagcaggtcccaggcaatt

SEQ ID NO: 46415 - DNA, 24 bp, Homo sapiens
cctggaaagcaggtcccaggcaat

SEQ ID NO: 46416 - DNA, 24 bp, Homo sapiens
acctggaaagcaggtcccaggcaa

SEQ ID NO: 46417 - DNA, 24 bp, Homo sapiens
attcatacaagcactgattgatcc

SEQ ID NO: 46418 - DNA, 24 bp, Homo sapiens
cattcatacaagcactgattgatc

SEQ ID NO: 46419 - DNA, 24 bp, Homo sapiens
tcattcatacaagcactgattgat

SEQ ID NO: 46420 - DNA, 24 bp, Homo sapiens
aagattagcatgtgagtataaaat

SEQ ID NO: 46421 - DNA, 24 bp, Homo sapiens
aaagattagcatgtgagtataaaa

SEQ ID NO: 46422 - DNA, 24 bp, Homo sapiens
gaaagattagcatgtgagtataaa

SEQ ID NO: 46423 - DNA, 24 bp, Homo sapiens
tcatttcccaactattctaattac

SEQ ID NO: 46424 - DNA, 24 bp, Homo sapiens
atcatttcccaactattctaatta

SEQ ID NO: 46425 - DNA, 24 bp, Homo sapiens
aatcatttcccaactattctaatt

SEQ ID NO: 46426 - DNA, 24 bp, Homo sapiens
ctggggaccaggtgctaaacctgc

SEQ ID NO: 46427 - DNA, 24 bp, Homo sapiens
tctggggaccaggtgctaaacctg

SEQ ID NO: 46428 - DNA, 24 bp, Homo sapiens
ctctggggaccaggtgctaaacct

SEQ ID NO: 46429 - DNA, 25 bp, Homo sapiens
ctcggacagtttgctcatttattgc

SEQ ID NO: 46430 - DNA, 24 bp, Homo sapiens
gcctgccttctctcactaacgctc

SEQ ID NO: 46431 - DNA, 23 bp, Homo sapiens
cgcacgcacgcacacacacgggg

SEQ ID NO: 46432 - DNA, 24 bp, Homo sapiens
ccagatagcagctttattcacagt

SEQ ID NO: 46433 - DNA, 24 bp, Homo sapiens
accagatagcagctttattcacag

SEQ ID NO: 46434 - DNA, 24 bp, Homo sapiens
caccagatagcagctttattcaca

SEQ ID NO: 46435 - DNA, 23 bp, Homo sapiens
ctcacaggaagatgctgcgtcgg

SEQ ID NO: 46436 - DNA, 23 bp, Homo sapiens
gcgtccctgagtcccagagtcgg

SEQ ID NO: 46437 - DNA, 23 bp, Homo sapiens
ctggcatgggtgtgcatgtgggt

SEQ ID NO: 46438 - DNA, 24 bp, Homo sapiens
gaaaaaaacagccatggattgtta

SEQ ID NO: 46439 - DNA, 24 bp, Homo sapiens
agaaaaaaacagccatggattgtt

SEQ ID NO: 46440 - DNA, 24 bp, Homo sapiens
cagaaaaaaacagccatggattgt

SEQ ID NO: 46441 - DNA, 24 bp, Homo sapiens
aagaagccaagataattttagata

SEQ ID NO: 46442 - DNA, 24 bp, Homo sapiens
gaagaagccaagataattttagat

SEQ ID NO: 46443 - DNA, 24 bp, Homo sapiens
tgaagaagccaagataattttaga

SEQ ID NO: 46444 - DNA, 24 bp, Homo sapiens
tgaaaaaattggaaaagaccattt

SEQ ID NO: 46445 - DNA, 24 bp, Homo sapiens
atgaaaaaattggaaaagaccatt

SEQ ID NO: 46446 - DNA, 24 bp, Homo sapiens
gatgaaaaaattggaaaagaccat

SEQ ID NO: 46447 - DNA, 24 bp, Homo sapiens
agccacctctggggcagagaaggc

SEQ ID NO: 46448 - DNA, 24 bp, Homo sapiens
cagccacctctggggcagagaagg

SEQ ID NO: 46449 - DNA, 24 bp, Homo sapiens
tcagccacctctggggcagagaag

SEQ ID NO: 46450 - DNA, 23 bp, Homo sapiens
tgacaggaaccagcggtgactct

SEQ ID NO: 46451 - DNA, 25 bp, Homo sapiens
ctctgtctcctgaagatgaagtggc

SEQ ID NO: 46452 - DNA, 23 bp, Homo sapiens
ctctttcccaatgccaccagccc

SEQ ID NO: 46453 - DNA, 25 bp, Homo sapiens
ccagccacagacgagccatatacac

SEQ ID NO: 46454 - DNA, 25 bp, Homo sapiens
ggctgtgggacttgaagactatggg

SEQ ID NO: 46455 - DNA, 25 bp, Homo sapiens
actatattccacgccaggtacgaac

SEQ ID NO: 46456 - DNA, 23 bp, Homo sapiens
gagatccgcatcctcgcagtgat

SEQ ID NO: 46457 - DNA, 23 bp, Homo sapiens
cagagccaccacgaccatccagt

SEQ ID NO: 46458 - DNA, 24 bp, Homo sapiens
agtatctgaccatcgctgcttcca

SEQ ID NO: 46459 - DNA, 23 bp, Homo sapiens
gatgctggcgttgtgcgtatggt

SEQ ID NO: 46460 - DNA, 23 bp, Homo sapiens
agcaaacagcgatgtcccagacg

SEQ ID NO: 46461 - DNA, 23 bp, Homo sapiens
acgagtgcaggagccataatgtc

SEQ ID NO: 46462 - DNA, 25 bp, Homo sapiens
gccagcttcttcactacaggacctc

SEQ ID NO: 46463 - DNA, 24 bp, Homo sapiens
atgctcatcaaggtcgctgatcgg

SEQ ID NO: 46464 - DNA, 23 bp, Homo sapiens
gcagccagcactcacccagcctg

SEQ ID NO: 46465 - DNA, 23 bp, Homo sapiens
agcagcagcagcaagacggactc

SEQ ID NO: 46466 - DNA, 23 bp, Homo sapiens
gaggcagcggcggcagcaggaga

SEQ ID NO: 46467 - DNA, 23 bp, Homo sapiens
ccgccgggccgggccgggtgtcg

SEQ ID NO: 46468 - DNA, 24 bp, Homo sapiens
tggctattggaggtggaaaggagt

SEQ ID NO: 46469 - DNA, 24 bp, Homo sapiens
gccaggatttaggagcaggagccg

SEQ ID NO: 46470 - DNA, 24 bp, Homo sapiens
ctgctccaagacatgccgttcagg

SEQ ID NO: 46471 - DNA, 24 bp, Homo sapiens
gcatgaaagtaccaggctcagagg

SEQ ID NO: 46472 - DNA, 24 bp, Homo sapiens
ggtggagtctgtggttgtgagaag

SEQ ID NO: 46473 - DNA, 24 bp, Homo sapiens
gctgatgtgaaaaacctttctggg

SEQ ID NO: 46474 - DNA, 23 bp, Homo sapiens
cctgctgctggtgctcatcttcc

SEQ ID NO: 46475 - DNA, 23 bp, Homo sapiens
ctgatcgtgttggcggtgcttga

SEQ ID NO: 46476 - DNA, 23 bp, Homo sapiens
aacctcagtgcctaccagagcgt

SEQ ID NO: 46477 - DNA, 23 bp, Homo sapiens
cctgctgctggtgctcatcttcc

SEQ ID NO: 46478 - DNA, 24 bp, Homo sapiens
gctggcatacggcatctactactg

SEQ ID NO: 46479 - DNA, 23 bp, Homo sapiens
aacctcagtgcctaccagagcgt

SEQ ID NO: 46480 - DNA, 23 bp, Homo sapiens
aacctcagtgcctaccagagcgt

SEQ ID NO: 46481 - DNA, 24 bp, Homo sapiens
gctggcatacggcatctactactg

SEQ ID NO: 46482 - DNA, 23 bp, Homo sapiens
cctggtgctggtgctgatcctgg

SEQ ID NO: 46483 - DNA, 24 bp, Homo sapiens
caaaaagaacactgaatagcttct

SEQ ID NO: 46484 - DNA, 24 bp, Homo sapiens
acaaaaagaacactgaatagcttc

SEQ ID NO: 46485 - DNA, 24 bp, Homo sapiens
cacaaaaagaacactgaatagctt

SEQ ID NO: 46486 - DNA, 24 bp, Homo sapiens
ctgacattaaggatgtgtattatg

SEQ ID NO: 46487 - DNA, 24 bp, Homo sapiens
gctgacattaaggatgtgtattat

SEQ ID NO: 46488 - DNA, 24 bp, Homo sapiens
ggctgacattaaggatgtgtatta

SEQ ID NO: 46489 - DNA, 25 bp, Homo sapiens
cctgtgaatgtccgagaactgagcc

SEQ ID NO: 46490 - DNA, 23 bp, Homo sapiens
ctgaggtggagcaggtgagtggc

SEQ ID NO: 46491 - DNA, 23 bp, Homo sapiens
gagcaatctcagtgaccttcagg

SEQ ID NO: 46492 - DNA, 24 bp, Homo sapiens
atcttccagaactacaaggcggcg

SEQ ID NO: 46493 - DNA, 24 bp, Homo sapiens
tactgctacatgctgctgctggtg

SEQ ID NO: 46494 - DNA, 24 bp, Homo sapiens
gctacgccatgatcctgtggttcc

SEQ ID NO: 46495 - DNA, 23 bp, Homo sapiens
tctcatcgtcctgctctgctgct

SEQ ID NO: 46496 - DNA, 24 bp, Homo sapiens
ccagtgtccagtgaagcgtctgag

SEQ ID NO: 46497 - DNA, 23 bp, Homo sapiens
ccgcagccaccaccacaccgtag

SEQ ID NO: 46498 - DNA, 25 bp, Homo sapiens
atggtgtttcacatggaagaggacc

SEQ ID NO: 46499 - DNA, 25 bp, Homo sapiens
gtggaccctgcctcaaaactttcat

SEQ ID NO: 46500 - DNA, 23 bp, Homo sapiens
ggaacgagtgctctcagcaagaa

SEQ ID NO: 46501 - DNA, 23 bp, Homo sapiens
gctcctcctggcgttgaactgtc

SEQ ID NO: 46502 - DNA, 23 bp, Homo sapiens
cagcccgaagcagccagaccagc

SEQ ID NO: 46503 - DNA, 23 bp, Homo sapiens
gcctgattaaccagcttctccag

SEQ ID NO: 46504 - DNA, 24 bp, Homo sapiens
tgttttctgctccccaatcccctg

SEQ ID NO: 46505 - DNA, 24 bp, Homo sapiens
ttgagagggattccaatggggatt

SEQ ID NO: 46506 - DNA, 23 bp, Homo sapiens
gtcgcggagacggcttcgtggag

SEQ ID NO: 46507 - DNA, 23 bp, Homo sapiens
ctcagtgtcagcggatacggcaa

SEQ ID NO: 46508 - DNA, 25 bp, Homo sapiens
cgaagagactgacaagtacacctgc

SEQ ID NO: 46509 - DNA, 23 bp, Homo sapiens
tccacacacctcagcctcccaaa

SEQ ID NO: 46510 - DNA, 24 bp, Homo sapiens
tcctgcctggctctagtgggccgg

SEQ ID NO: 46511 - DNA, 24 bp, Homo sapiens
gcagcagccgacccccctcctgag

SEQ ID NO: 46512 - DNA, 24 bp, Homo sapiens
cattgtctccatgggcttctcccg

SEQ ID NO: 46513 - DNA, 24 bp, Homo sapiens
aagttcaccttcggcttagactgg

SEQ ID NO: 46514 - DNA, 24 bp, Homo sapiens
atgtgtccatcgagatgccagagg

SEQ ID NO: 46515 - DNA, 24 bp, Homo sapiens
ggagaggaggagctgccagacatt

SEQ ID NO: 46516 - DNA, 23 bp, Homo sapiens
cctgctggtgctcgtggggagag

SEQ ID NO: 46517 - DNA, 24 bp, Homo sapiens
ccaggacataaggggagcaaggga

SEQ ID NO: 46518 - DNA, 23 bp, Homo sapiens
aggaaggactgggcagaaaggca

SEQ ID NO: 46519 - DNA, 24 bp, Homo sapiens
ccgatgaggaggtggatgagatga

SEQ ID NO: 46520 - DNA, 24 bp, Homo sapiens
gccaggtcaattatgaagagtttg

SEQ ID NO: 46521 - DNA, 24 bp, Homo sapiens
tgactgagaatctgataaagcaac

SEQ ID NO: 46522 - DNA, 24 bp, Homo sapiens
tctctcttcaacactcccctgcgt

SEQ ID NO: 46523 - DNA, 24 bp, Homo sapiens
cataagttgaagccctccccagat

SEQ ID NO: 46524 - DNA, 24 bp, Homo sapiens
gagcctctgccctcctccagcccg

SEQ ID NO: 46525 - DNA, 24 bp, Homo sapiens
tgcccctcatctcttccttttgcc

SEQ ID NO: 46526 - DNA, 24 bp, Homo sapiens
cccggttctagcaaacaccaattg

SEQ ID NO: 46527 - DNA, 24 bp, Homo sapiens
tgagaatctgataaagcaacaaaa

SEQ ID NO: 46528 - DNA, 24 bp, Homo sapiens
tttcttcacagacagaaaaagcga

SEQ ID NO: 46529 - DNA, 24 bp, Homo sapiens
atttcttcacagacagaaaaagcg

SEQ ID NO: 46530 - DNA, 24 bp, Homo sapiens
aatttcttcacagacagaaaaagc

SEQ ID NO: 46531 - DNA, 24 bp, Homo sapiens
ccgacgacatggagccgaagaagg

SEQ ID NO: 46532 - DNA, 24 bp, Homo sapiens
cgtgaccgtggtgggcttcctcat

SEQ ID NO: 46533 - DNA, 24 bp, Homo sapiens
acacgcacccacccacccacccag

SEQ ID NO: 46534 - DNA, 24 bp, Homo sapiens
tcatatcaggttgacgaacggaca

SEQ ID NO: 46535 - DNA, 24 bp, Homo sapiens
gcctttgccgcccaccactattcg

SEQ ID NO: 46536 - DNA, 24 bp, Homo sapiens
gccgctcagcaggacctttgttta

SEQ ID NO: 46537 - DNA, 24 bp, Homo sapiens
gtggcatcttcctctagtccttcc

SEQ ID NO: 46538 - DNA, 24 bp, Homo sapiens
ctggtagagacatcttcaaggcat

SEQ ID NO: 46539 - DNA, 24 bp, Homo sapiens
tcttggagacaggcaggaggtggg

SEQ ID NO: 46540 - DNA, 24 bp, Homo sapiens
atttcaaacagctagttaaaggcc

SEQ ID NO: 46541 - DNA, 24 bp, Homo sapiens
tatttcaaacagctagttaaaggc

SEQ ID NO: 46542 - DNA, 24 bp, Homo sapiens
ttatttcaaacagctagttaaagg

SEQ ID NO: 46543 - DNA, 23 bp, Homo sapiens
cggagcagcaggaccaggaaggg

SEQ ID NO: 46544 - DNA, 23 bp, Homo sapiens
ccgcctccgcctccgccgcctag

SEQ ID NO: 46545 - DNA, 23 bp, Homo sapiens
gcgaagtccccgtctccagttca

SEQ ID NO: 46546 - DNA, 24 bp, Homo sapiens
gtggagagaagaaaatcatttgac

SEQ ID NO: 46547 - DNA, 24 bp, Homo sapiens
cgtggagagaagaaaatcatttga

SEQ ID NO: 46548 - DNA, 24 bp, Homo sapiens
ccgtggagagaagaaaatcatttg

SEQ ID NO: 46549 - DNA, 24 bp, Homo sapiens
tttccaagtagaaaagaaacgctt

SEQ ID NO: 46550 - DNA, 24 bp, Homo sapiens
gtttccaagtagaaaagaaacgct

SEQ ID NO: 46551 - DNA, 24 bp, Homo sapiens
tgtttccaagtagaaaagaaacgc

SEQ ID NO: 46552 - DNA, 23 bp, Homo sapiens
agctggatcttgctcacactctt

SEQ ID NO: 46553 - DNA, 24 bp, Homo sapiens
attatgcagatgcacggctggagg

SEQ ID NO: 46554 - DNA, 24 bp, Homo sapiens
ctttcttcaaggtggactcccttt

SEQ ID NO: 46555 - DNA, 24 bp, Homo sapiens
cctttcttcaaggtggactccctt

SEQ ID NO: 46556 - DNA, 24 bp, Homo sapiens
ccctttcttcaaggtggactccct

SEQ ID NO: 46557 - DNA, 24 bp, Homo sapiens
ttcagagaaggtgcggctggagat

SEQ ID NO: 46558 - DNA, 24 bp, Homo sapiens
atggaacactgctcgctgcttgag

SEQ ID NO: 46559 - DNA, 24 bp, Homo sapiens
ttaccatcgaccgcatcaagccag

SEQ ID NO: 46560 - DNA, 24 bp, Homo sapiens
cctgacacggtggctaatgcttcg

SEQ ID NO: 46561 - DNA, 24 bp, Homo sapiens
atctcgctcaccaccacctccctc

SEQ ID NO: 46562 - DNA, 24 bp, Homo sapiens
ttaccatcgaccgcatcaagccag

SEQ ID NO: 46563 - DNA, 24 bp, Homo sapiens
atctcgctcaccaccacctccctc

SEQ ID NO: 46564 - DNA, 24 bp, Homo sapiens
cattaccatcgaccgcatcaagcc

SEQ ID NO: 46565 - DNA, 24 bp, Homo sapiens
ggaaatagtcaagacgccagggtc

SEQ ID NO: 46566 - DNA, 24 bp, Homo sapiens
tttatttctagctgtgaattcctt

SEQ ID NO: 46567 - DNA, 24 bp, Homo sapiens
ctttatttctagctgtgaattcct

SEQ ID NO: 46568 - DNA, 24 bp, Homo sapiens
gctttatttctagctgtgaattcc

SEQ ID NO: 46569 - DNA, 24 bp, Homo sapiens
agaaagaaataatgaagcattgga

SEQ ID NO: 46570 - DNA, 24 bp, Homo sapiens
cagaaagaaataatgaagcattgg

SEQ ID NO: 46571 - DNA, 24 bp, Homo sapiens
acagaaagaaataatgaagcattg

SEQ ID NO: 46572 - DNA, 23 bp, Homo sapiens
ttgtctctctgtcagtggcggct

SEQ ID NO: 46573 - DNA, 23 bp, Homo sapiens
ctctggaggcaggctgggcggtg

SEQ ID NO: 46574 - DNA, 23 bp, Homo sapiens
gagactggcgggggtggacgccc

SEQ ID NO: 46575 - DNA, 24 bp, Homo sapiens
ctaggaaatggccacaacaagttg

SEQ ID NO: 46576 - DNA, 24 bp, Homo sapiens
cctaggaaatggccacaacaagtt

SEQ ID NO: 46577 - DNA, 24 bp, Homo sapiens
acctaggaaatggccacaacaagt

SEQ ID NO: 46578 - DNA, 23 bp, Homo sapiens
ccaggaagcagcagcaagaacca

SEQ ID NO: 46579 - DNA, 23 bp, Homo sapiens
gcagccgtccacttcagcccagg

SEQ ID NO: 46580 - DNA, 25 bp, Homo sapiens
cagccctatcacctcatctcccgaa

SEQ ID NO: 46581 - DNA, 23 bp, Homo sapiens
ctggtcagccacagtgccgtcag

SEQ ID NO: 46582 - DNA, 23 bp, Homo sapiens
ccctctacagtgcccagaatcat

SEQ ID NO: 46583 - DNA, 23 bp, Homo sapiens
aggctccagaccgctctcaactt

SEQ ID NO: 46584 - DNA, 25 bp, Homo sapiens
gcaggatgaggagataactttgagc

SEQ ID NO: 46585 - DNA, 25 bp, Homo sapiens
ggcatctcagactcactcaccacaa

SEQ ID NO: 46586 - DNA, 25 bp, Homo sapiens
tcaacagttcccaggagtttgctca

SEQ ID NO: 46587 - DNA, 24 bp, Homo sapiens
ggatgcagaggatattgtgggcac

SEQ ID NO: 46588 - DNA, 24 bp, Homo sapiens
tggatgcagaggatattgtgggca

SEQ ID NO: 46589 - DNA, 24 bp, Homo sapiens
ctggatgcagaggatattgtgggc

SEQ ID NO: 46590 - DNA, 24 bp, Homo sapiens
aagcaaatgaggtaagtttataac

SEQ ID NO: 46591 - DNA, 24 bp, Homo sapiens
taagcaaatgaggtaagtttataa

SEQ ID NO: 46592 - DNA, 24 bp, Homo sapiens
ataagcaaatgaggtaagtttata

SEQ ID NO: 46593 - DNA, 24 bp, Homo sapiens
actataaccaagtaagttttaaaa

SEQ ID NO: 46594 - DNA, 24 bp, Homo sapiens
gactataaccaagtaagttttaaa

SEQ ID NO: 46595 - DNA, 24 bp, Homo sapiens
agactataaccaagtaagttttaa

SEQ ID NO: 46596 - DNA, 24 bp, Homo sapiens
caaagaaataggcaagtactctcc

SEQ ID NO: 46597 - DNA, 24 bp, Homo sapiens
acaaagaaataggcaagtactctc

SEQ ID NO: 46598 - DNA, 24 bp, Homo sapiens
aacaaagaaataggcaagtactct

SEQ ID NO: 46599 - DNA, 23 bp, Homo sapiens
cctgctgctgctgttcacggctg

SEQ ID NO: 46600 - DNA, 23 bp, Homo sapiens
cagggcactggggagggctgagg

SEQ ID NO: 46601 - DNA, 23 bp, Homo sapiens
gtccagctgggctcagcttctga

SEQ ID NO: 46602 - DNA, 23 bp, Homo sapiens
ggaaagtttgtccggcggcagcg

SEQ ID NO: 46603 - DNA, 23 bp, Homo sapiens
ccctcagcgcccccagcacgccg

SEQ ID NO: 46604 - DNA, 23 bp, Homo sapiens
gggactccggcgggggatgcgcg

SEQ ID NO: 46605 - DNA, 24 bp, Homo sapiens
cggtggggaggccggggagggggc

SEQ ID NO: 46606 - DNA, 24 bp, Homo sapiens
gggggctgcgggcggtcggggctc

SEQ ID NO: 46607 - DNA, 24 bp, Homo sapiens
cggcgatggcggcggcggcggcgg

SEQ ID NO: 46608 - DNA, 24 bp, Homo sapiens
cgaactccagggctcaagtgatcc

SEQ ID NO: 46609 - DNA, 24 bp, Homo sapiens
tgagccgccacacccagcccacat

SEQ ID NO: 46610 - DNA, 24 bp, Homo sapiens
tcttatgggaaaccagacatggga

SEQ ID NO: 46611 - DNA, 24 bp, Homo sapiens
taagaaaccctagattaaaaaaag

SEQ ID NO: 46612 - DNA, 24 bp, Homo sapiens
ttaagaaaccctagattaaaaaaa

SEQ ID NO: 46613 - DNA, 24 bp, Homo sapiens
cttaagaaaccctagattaaaaaa

SEQ ID NO: 46614 - DNA, 24 bp, Homo sapiens
ggcgattccagacaaagtttcact

SEQ ID NO: 46615 - DNA, 24 bp, Homo sapiens
cggcgattccagacaaagtttcac

SEQ ID NO: 46616 - DNA, 24 bp, Homo sapiens
acggcgattccagacaaagtttca

SEQ ID NO: 46617 - DNA, 24 bp, Homo sapiens
aaagtttcactctgtcgcccaagg

SEQ ID NO: 46618 - DNA, 24 bp, Homo sapiens
tgtcccagaactcaaatatctgca

SEQ ID NO: 46619 - DNA, 24 bp, Homo sapiens
ttcactcaaagtgcggccccgggg

SEQ ID NO: 46620 - DNA, 24 bp, Homo sapiens
cttcactcaaagtgcggccccggg

SEQ ID NO: 46621 - DNA, 24 bp, Homo sapiens
acttcactcaaagtgcggccccgg

SEQ ID NO: 46622 - DNA, 24 bp, Homo sapiens
taaagaaaacaataaaacttaaag

SEQ ID NO: 46623 - DNA, 24 bp, Homo sapiens
ttaaagaaaacaataaaacttaaa

SEQ ID NO: 46624 - DNA, 24 bp, Homo sapiens
gttaaagaaaacaataaaacttaa

SEQ ID NO: 46625 - DNA, 25 bp, Homo sapiens
gggtgagcagcaaagttattctacc

SEQ ID NO: 46626 - DNA, 25 bp, Homo sapiens
ccaaggctatggacaagcatcacaa

SEQ ID NO: 46627 - DNA, 25 bp, Homo sapiens
tggctatgggcaaacgactgattcc

SEQ ID NO: 46628 - DNA, 25 bp, Homo sapiens
acaaggacacaggaaagccaaaggg

SEQ ID NO: 46629 - DNA, 25 bp, Homo sapiens
atgagaggaggtggaagtggaggtg

SEQ ID NO: 46630 - DNA, 25 bp, Homo sapiens
tggaggatatagaggtcgtggaggc

SEQ ID NO: 46631 - DNA, 24 bp, Homo sapiens
cacttgtgttggtaaataaatatt

SEQ ID NO: 46632 - DNA, 24 bp, Homo sapiens
ccacttgtgttggtaaataaatat

SEQ ID NO: 46633 - DNA, 24 bp, Homo sapiens
cccacttgtgttggtaaataaata

SEQ ID NO: 46634 - DNA, 23 bp, Homo sapiens
gagcaccaacaccaccatcgagg

SEQ ID NO: 46635 - DNA, 24 bp, Homo sapiens
accaaagtgcggaaacaggaaatt

SEQ ID NO: 46636 - DNA, 25 bp, Homo sapiens
gagtcctacacgaagatgtgcgacc

SEQ ID NO: 46637 - DNA, 24 bp, Homo sapiens
atcttacaaagggagcagaagaaa

SEQ ID NO: 46638 - DNA, 24 bp, Homo sapiens
tatcttacaaagggagcagaagaa

SEQ ID NO: 46639 - DNA, 24 bp, Homo sapiens
ctatcttacaaagggagcagaaga

SEQ ID NO: 46640 - DNA, 24 bp, Homo sapiens
tcaattcaaaggtaagtttcctga

SEQ ID NO: 46641 - DNA, 24 bp, Homo sapiens
ttcaattcaaaggtaagtttcctg

SEQ ID NO: 46642 - DNA, 24 bp, Homo sapiens
cttcaattcaaaggtaagtttcct

SEQ ID NO: 46643 - DNA, 24 bp, Homo sapiens
cagataaataggtgagtatttttc

SEQ ID NO: 46644 - DNA, 24 bp, Homo sapiens
tcagataaataggtgagtattttt

SEQ ID NO: 46645 - DNA, 24 bp, Homo sapiens
gtcagataaataggtgagtatttt

SEQ ID NO: 46646 - DNA, 24 bp, Homo sapiens
tatttttacagtgtatgatatttg

SEQ ID NO: 46647 - DNA, 24 bp, Homo sapiens
ttatttttacagtgtatgatattt

SEQ ID NO: 46648 - DNA, 24 bp, Homo sapiens
tttatttttacagtgtatgatatt

SEQ ID NO: 46649 - DNA, 24 bp, Homo sapiens
ggctccaggctgacattaccatca

SEQ ID NO: 46650 - DNA, 23 bp, Homo sapiens
catgcttaactggaccaccctgc

SEQ ID NO: 46651 - DNA, 23 bp, Homo sapiens
tgtcaccctccgaccacagagag

SEQ ID NO: 46652 - DNA, 24 bp, Homo sapiens
attttagacagatctgagaacaat

SEQ ID NO: 46653 - DNA, 24 bp, Homo sapiens
tattttagacagatctgagaacaa

SEQ ID NO: 46654 - DNA, 24 bp, Homo sapiens
ttattttagacagatctgagaaca

SEQ ID NO: 46655 - DNA, 24 bp, Homo sapiens
attttcatcagctagacattgaga

SEQ ID NO: 46656 - DNA, 24 bp, Homo sapiens
tattttcatcagctagacattgag

SEQ ID NO: 46657 - DNA, 24 bp, Homo sapiens
ttattttcatcagctagacattga

SEQ ID NO: 46658 - DNA, 24 bp, Homo sapiens
gggcagaaagtgactccagtggtg

SEQ ID NO: 46659 - DNA, 23 bp, Homo sapiens
ggtgaagctagtgggcgccattt

SEQ ID NO: 46660 - DNA, 24 bp, Homo sapiens
atattttacagatttaaggcaaga

SEQ ID NO: 46661 - DNA, 24 bp, Homo sapiens
aatattttacagatttaaggcaag

SEQ ID NO: 46662 - DNA, 24 bp, Homo sapiens
caatattttacagatttaaggcaa

SEQ ID NO: 46663 - DNA, 24 bp, Homo sapiens
ttctttggaagatgggggacagga

SEQ ID NO: 46664 - DNA, 24 bp, Homo sapiens
attctttggaagatgggggacagg

SEQ ID NO: 46665 - DNA, 24 bp, Homo sapiens
cattctttggaagatgggggacag

SEQ ID NO: 46666 - DNA, 24 bp, Homo sapiens
aagataaaacagtatgtgcaaatc

SEQ ID NO: 46667 - DNA, 24 bp, Homo sapiens
gaagataaaacagtatgtgcaaat

SEQ ID NO: 46668 - DNA, 24 bp, Homo sapiens
ggaagataaaacagtatgtgcaaa

SEQ ID NO: 46669 - DNA, 23 bp, Homo sapiens
ggactgctgctggaccgccgagg

SEQ ID NO: 46670 - DNA, 23 bp, Homo sapiens
gcgctccctcgtagccaacgtgg

SEQ ID NO: 46671 - DNA, 23 bp, Homo sapiens
ccatcgtggggctctcgctcagc

SEQ ID NO: 46672 - DNA, 24 bp, Homo sapiens
accaccatagaggatgaagacgct

SEQ ID NO: 46673 - DNA, 25 bp, Homo sapiens
agcctcaaaccaccgtcatccataa

SEQ ID NO: 46674 - DNA, 25 bp, Homo sapiens
caagaaagcagatggagtcaagccc

SEQ ID NO: 46675 - DNA, 23 bp, Homo sapiens
gcctgagcctgagcctgacattg

SEQ ID NO: 46676 - DNA, 23 bp, Homo sapiens
cctacctgttgtgcggacctcgg

SEQ ID NO: 46677 - DNA, 25 bp, Homo sapiens
cagcaccttctgaggagttgaccag

SEQ ID NO: 46678 - DNA, 24 bp, Homo sapiens
aagggaaatctgtgtcaagaaata

SEQ ID NO: 46679 - DNA, 24 bp, Homo sapiens
gaagggaaatctgtgtcaagaaat

SEQ ID NO: 46680 - DNA, 24 bp, Homo sapiens
agaagggaaatctgtgtcaagaaa

SEQ ID NO: 46681 - DNA, 23 bp, Homo sapiens
ccaccagatgggctcctgagacc

SEQ ID NO: 46682 - DNA, 23 bp, Homo sapiens
gggtcccctattgagtgccgact

SEQ ID NO: 46683 - DNA, 23 bp, Homo sapiens
ctgctcctccagccacacccctc

SEQ ID NO: 46684 - DNA, 23 bp, Homo sapiens
cctggctgctgctgctgctactg

SEQ ID NO: 46685 - DNA, 23 bp, Homo sapiens
agatctcggtggaacttcagaaa

SEQ ID NO: 46686 - DNA, 23 bp, Homo sapiens
gcagtctgcctttcaaccatgcc

SEQ ID NO: 46687 - DNA, 25 bp, Homo sapiens
tctgggtctcagtttcctcatctgt

SEQ ID NO: 46688 - DNA, 25 bp, Homo sapiens
tgataataacgcctacctcttggga

SEQ ID NO: 46689 - DNA, 25 bp, Homo sapiens
aatcgtctgtgtggccttaggcaag

SEQ ID NO: 46690 - DNA, 24 bp, Homo sapiens
atctttttaagaaacagcacttct

SEQ ID NO: 46691 - DNA, 24 bp, Homo sapiens
aatctttttaagaaacagcacttc

SEQ ID NO: 46692 - DNA, 24 bp, Homo sapiens
caatctttttaagaaacagcactt

SEQ ID NO: 46693 - DNA, 24 bp, Homo sapiens
ggagaaaagaggaatattagttag

SEQ ID NO: 46694 - DNA, 24 bp, Homo sapiens
tggagaaaagaggaatattagtta

SEQ ID NO: 46695 - DNA, 24 bp, Homo sapiens
gtggagaaaagaggaatattagtt

SEQ ID NO: 46696 - DNA, 24 bp, Homo sapiens
ggctgagtgtgctggagtgaggat

SEQ ID NO: 46697 - DNA, 24 bp, Homo sapiens
cgagacggttaggctacggcttca

SEQ ID NO: 46698 - DNA, 24 bp, Homo sapiens
ttccgttgagcaccaagcaagatg

SEQ ID NO: 46699 - DNA, 25 bp, Homo sapiens
aagtaacaaacgaaatgagccaggg

SEQ ID NO: 46700 - DNA, 24 bp, Homo sapiens
tctatgagagcaggtcaaggtggc

SEQ ID NO: 46701 - DNA, 23 bp, Homo sapiens
ggaatggttgtggtgggctggac

SEQ ID NO: 46702 - DNA, 24 bp, Homo sapiens
ctttaacagggaaaaaaagatgtg

SEQ ID NO: 46703 - DNA, 24 bp, Homo sapiens
tctttaacagggaaaaaaagatgt

SEQ ID NO: 46704 - DNA, 24 bp, Homo sapiens
ttctttaacagggaaaaaaagatg

SEQ ID NO: 46705 - DNA, 24 bp, Homo sapiens
agtctttaaaggtaatatcaaatt

SEQ ID NO: 46706 - DNA, 24 bp, Homo sapiens
cagtctttaaaggtaatatcaaat

SEQ ID NO: 46707 - DNA, 24 bp, Homo sapiens
acagtctttaaaggtaatatcaaa

SEQ ID NO: 46708 - DNA, 24 bp, Homo sapiens
tgctggagcggatccgagccaagg

SEQ ID NO: 46709 - DNA, 24 bp, Homo sapiens
ctgctggagcggatccgagccaag

SEQ ID NO: 46710 - DNA, 24 bp, Homo sapiens
tctgctggagcggatccgagccaa

SEQ ID NO: 46711 - DNA, 24 bp, Homo sapiens
ccatgctgctggtgctgggtttgt

SEQ ID NO: 46712 - DNA, 24 bp, Homo sapiens
gccatgctgctggtgctgggtttg

SEQ ID NO: 46713 - DNA, 24 bp, Homo sapiens
ggccatgctgctggtgctgggttt

SEQ ID NO: 46714 - DNA, 25 bp, Homo sapiens
gtccaatgtctcagaggcctgttct

SEQ ID NO: 46715 - DNA, 24 bp, Homo sapiens
catggtaataaaccgtatttataa

SEQ ID NO: 46716 - DNA, 24 bp, Homo sapiens
agctagtaaagtatacagatttgt

SEQ ID NO: 46717 - DNA, 24 bp, Homo sapiens
aagctagtaaagtatacagatttg

SEQ ID NO: 46718 - DNA, 24 bp, Homo sapiens
aaagctagtaaagtatacagattt

SEQ ID NO: 46719 - DNA, 24 bp, Homo sapiens
gatcttttgatttcatgtaagtag

SEQ ID NO: 46720 - DNA, 24 bp, Homo sapiens
agatcttttgatttcatgtaagta

SEQ ID NO: 46721 - DNA, 24 bp, Homo sapiens
gagatcttttgatttcatgtaagt

SEQ ID NO: 46722 - DNA, 23 bp, Homo sapiens
ggctgctttggctgaggaacgaa

SEQ ID NO: 46723 - DNA, 25 bp, Homo sapiens
tgggataatgggattacagtgggca

SEQ ID NO: 46724 - DNA, 23 bp, Homo sapiens
aagtggtggtggacagtaaggaa

SEQ ID NO: 46725 - DNA, 24 bp, Homo sapiens
ggtgattcttgtgcctcagcctcc

SEQ ID NO: 46726 - DNA, 23 bp, Homo sapiens
ccaccaccacgctcagagtctcg

SEQ ID NO: 46727 - DNA, 25 bp, Homo sapiens
ccaaagaaggtaaagggagcaagcc

SEQ ID NO: 46728 - DNA, 25 bp, Homo sapiens
tggagtacagtggcacaatctcagc

SEQ ID NO: 46729 - DNA, 25 bp, Homo sapiens
catctgccaccacgcctggataatt

SEQ ID NO: 46730 - DNA, 23 bp, Homo sapiens
atgtgacctggagagtgggcttc

SEQ ID NO: 46731 - DNA, 23 bp, Homo sapiens
gaccgagagacaccccaggaagg

SEQ ID NO: 46732 - DNA, 23 bp, Homo sapiens
gcgatgaaagccggttgggatct

SEQ ID NO: 46733 - DNA, 23 bp, Homo sapiens
gcaggcaggccccaaataagctg

SEQ ID NO: 46734 - DNA, 23 bp, Homo sapiens
gcggatactggacaccttcctgg

SEQ ID NO: 46735 - DNA, 23 bp, Homo sapiens
tgtccaaggtgccacgctcgtcc

SEQ ID NO: 46736 - DNA, 23 bp, Homo sapiens
caggtggtgctggtggagaatgg

SEQ ID NO: 46737 - DNA, 23 bp, Homo sapiens
ggaggctcaggtggaggaggcac

SEQ ID NO: 46738 - DNA, 23 bp, Homo sapiens
caggtggtgctggtggagaatgg

SEQ ID NO: 46739 - DNA, 23 bp, Homo sapiens
tgtccaaggtgccacgctcgtcc

SEQ ID NO: 46740 - DNA, 24 bp, Homo sapiens
catgtggaactgaagaagaaatgc

SEQ ID NO: 46741 - DNA, 24 bp, Homo sapiens
ccatgtggaactgaagaagaaatg

SEQ ID NO: 46742 - DNA, 24 bp, Homo sapiens
gccatgtggaactgaagaagaaat

SEQ ID NO: 46743 - DNA, 25 bp, Homo sapiens
tatgatgttcaccaccagtgccagc

SEQ ID NO: 46744 - DNA, 24 bp, Homo sapiens
tacatcacccgcttcttggaccga

SEQ ID NO: 46745 - DNA, 24 bp, Homo sapiens
tgtcagcctcaccgcagttgtaac

SEQ ID NO: 46746 - DNA, 24 bp, Homo sapiens
atattttgtagtattgttatgaca

SEQ ID NO: 46747 - DNA, 24 bp, Homo sapiens
catattttgtagtattgttatgac

SEQ ID NO: 46748 - DNA, 24 bp, Homo sapiens
acatattttgtagtattgttatga

SEQ ID NO: 46749 - DNA, 25 bp, Homo sapiens
aggcttcaacttctacacggagagg

SEQ ID NO: 46750 - DNA, 23 bp, Homo sapiens
ggaggacaagtgccgagtgtgtg

SEQ ID NO: 46751 - DNA, 23 bp, Homo sapiens
gcgtcttcagcccagcctcacct

SEQ ID NO: 46752 - DNA, 24 bp, Homo sapiens
aaaaacccaagatggacaaaatat

SEQ ID NO: 46753 - DNA, 24 bp, Homo sapiens
aaaaaacccaagatggacaaaata

SEQ ID NO: 46754 - DNA, 24 bp, Homo sapiens
caaaaaacccaagatggacaaaat

SEQ ID NO: 46755 - DNA, 24 bp, Homo sapiens
tttcacacctgaataaaaggcaaa

SEQ ID NO: 46756 - DNA, 24 bp, Homo sapiens
atttcacacctgaataaaaggcaa

SEQ ID NO: 46757 - DNA, 24 bp, Homo sapiens
aatttcacacctgaataaaaggca

SEQ ID NO: 46758 - DNA, 24 bp, Homo sapiens
tgatattacaggagaatccaaatc

SEQ ID NO: 46759 - DNA, 24 bp, Homo sapiens
ctgatattacaggagaatccaaat

SEQ ID NO: 46760 - DNA, 24 bp, Homo sapiens
tctgatattacaggagaatccaaa

SEQ ID NO: 46761 - DNA, 24 bp, Homo sapiens
tattcaaaaatgtaagtaagtata

SEQ ID NO: 46762 - DNA, 24 bp, Homo sapiens
ctattcaaaaatgtaagtaagtat

SEQ ID NO: 46763 - DNA, 24 bp, Homo sapiens
actattcaaaaatgtaagtaagta

SEQ ID NO: 46764 - DNA, 24 bp, Homo sapiens
gaattgagttgttttgtcagcctg

SEQ ID NO: 46765 - DNA, 24 bp, Homo sapiens
ggaattgagttgttttgtcagcct

SEQ ID NO: 46766 - DNA, 24 bp, Homo sapiens
gggaattgagttgttttgtcagcc

SEQ ID NO: 46767 - DNA, 24 bp, Homo sapiens
ctttctttgatctcaagaccagca

SEQ ID NO: 46768 - DNA, 24 bp, Homo sapiens
gctttctttgatctcaagaccagc

SEQ ID NO: 46769 - DNA, 24 bp, Homo sapiens
ggctttctttgatctcaagaccag

SEQ ID NO: 46770 - DNA, 23 bp, Homo sapiens
agcagcagcagcagcagcaacag

SEQ ID NO: 46771 - DNA, 23 bp, Homo sapiens
atggtctggcagtgtgtttagcg

SEQ ID NO: 46772 - DNA, 23 bp, Homo sapiens
gcgagcctgaggattctgcacaa

SEQ ID NO: 46773 - DNA, 23 bp, Homo sapiens
agcagcagcagcagcagcaacag

SEQ ID NO: 46774 - DNA, 24 bp, Homo sapiens
tgcaccagcttgttgctagtgtac

SEQ ID NO: 46775 - DNA, 23 bp, Homo sapiens
cggcggagagcagcacccagcag

SEQ ID NO: 46776 - DNA, 24 bp, Homo sapiens
tccactgccaggtaaggggacccg

SEQ ID NO: 46777 - DNA, 24 bp, Homo sapiens
ctccactgccaggtaaggggaccc

SEQ ID NO: 46778 - DNA, 24 bp, Homo sapiens
gctccactgccaggtaaggggacc

SEQ ID NO: 46779 - DNA, 24 bp, Homo sapiens
gacctggggcggtgagtgggggcg

SEQ ID NO: 46780 - DNA, 24 bp, Homo sapiens
ggacctggggcggtgagtgggggc

SEQ ID NO: 46781 - DNA, 24 bp, Homo sapiens
gggacctggggcggtgagtggggg

SEQ ID NO: 46782 - DNA, 24 bp, Homo sapiens
ttttggctcaggaggacctcgtgg

SEQ ID NO: 46783 - DNA, 24 bp, Homo sapiens
gttttggctcaggaggacctcgtg

SEQ ID NO: 46784 - DNA, 24 bp, Homo sapiens
ggttttggctcaggaggacctcgt

SEQ ID NO: 46785 - DNA, 24 bp, Homo sapiens
actgcctcatccgcctgttgtctg

SEQ ID NO: 46786 - DNA, 24 bp, Homo sapiens
gctctaccaggagtacaacgccta

SEQ ID NO: 46787 - DNA, 24 bp, Homo sapiens
cggaggtcctgtccttcatcctgg

SEQ ID NO: 46788 - DNA, 24 bp, Homo sapiens
atcgcaccaccacactccaacctg

SEQ ID NO: 46789 - DNA, 24 bp, Homo sapiens
gcactgtggttcacgcctgtaatc

SEQ ID NO: 46790 - DNA, 24 bp, Homo sapiens
gcccagtccaaagcatatcccaga

SEQ ID NO: 46791 - DNA, 25 bp, Homo sapiens
aatcattctaccaacaacagtgcca

SEQ ID NO: 46792 - DNA, 25 bp, Homo sapiens
actgcttgttccagaatcgagaaga

SEQ ID NO: 46793 - DNA, 25 bp, Homo sapiens
aaagcctatgaagaacagaaagcct

SEQ ID NO: 46794 - DNA, 24 bp, Homo sapiens
gtttgggttctggtcctggctgtg

SEQ ID NO: 46795 - DNA, 25 bp, Homo sapiens
tgctgtgaagacatttcccaagtgc

SEQ ID NO: 46796 - DNA, 25 bp, Homo sapiens
ggaaagaggtgattgttaggttgcg

SEQ ID NO: 46797 - DNA, 24 bp, Homo sapiens
ttatttattaggtaaagaagcagc

SEQ ID NO: 46798 - DNA, 24 bp, Homo sapiens
attatttattaggtaaagaagcag

SEQ ID NO: 46799 - DNA, 24 bp, Homo sapiens
tattatttattaggtaaagaagca

SEQ ID NO: 46800 - DNA, 24 bp, Homo sapiens
ctggtgcgcaggctggagtgcaat

SEQ ID NO: 46801 - DNA, 24 bp, Homo sapiens
gctggtgcgcaggctggagtgcaa

SEQ ID NO: 46802 - DNA, 24 bp, Homo sapiens
ggctggtgcgcaggctggagtgca

SEQ ID NO: 46803 - DNA, 24 bp, Homo sapiens
gtcctgatcagaaatactgctgac

SEQ ID NO: 46804 - DNA, 24 bp, Homo sapiens
ggtcctgatcagaaatactgctga

SEQ ID NO: 46805 - DNA, 24 bp, Homo sapiens
gggtcctgatcagaaatactgctg

SEQ ID NO: 46806 - DNA, 24 bp, Homo sapiens
tgtcttttcaggaaaaactatttc

SEQ ID NO: 46807 - DNA, 24 bp, Homo sapiens
ctgtcttttcaggaaaaactattt

SEQ ID NO: 46808 - DNA, 24 bp, Homo sapiens
tctgtcttttcaggaaaaactatt

SEQ ID NO: 46809 - DNA, 24 bp, Homo sapiens
aaaatctacagttaatggagtttc

SEQ ID NO: 46810 - DNA, 24 bp, Homo sapiens
caaaatctacagttaatggagttt

SEQ ID NO: 46811 - DNA, 24 bp, Homo sapiens
ccaaaatctacagttaatggagtt

SEQ ID NO: 46812 - DNA, 23 bp, Homo sapiens
ctctgtccctgcgtgaccttccg

SEQ ID NO: 46813 - DNA, 23 bp, Homo sapiens
cagcccttcacctctccgtgccg

SEQ ID NO: 46814 - DNA, 24 bp, Homo sapiens
catctgcattcacgtccctgtccc

SEQ ID NO: 46815 - DNA, 24 bp, Homo sapiens
aagaagtggagcgtgtcctgaagg

SEQ ID NO: 46816 - DNA, 23 bp, Homo sapiens
gagcaggaggaaggtggcaagtg

SEQ ID NO: 46817 - DNA, 23 bp, Homo sapiens
gccaagcactgcgtgaaggaagt

SEQ ID NO: 46818 - DNA, 24 bp, Homo sapiens
ggaggctagagatcatggaaggga

SEQ ID NO: 46819 - DNA, 24 bp, Homo sapiens
gggaggctagagatcatggaaggg

SEQ ID NO: 46820 - DNA, 24 bp, Homo sapiens
cgggaggctagagatcatggaagg

SEQ ID NO: 46821 - DNA, 23 bp, Homo sapiens
gccaacacggtgaaaccctgtct

SEQ ID NO: 46822 - DNA, 23 bp, Homo sapiens
aattagctggatgtggtggtgca

SEQ ID NO: 46823 - DNA, 23 bp, Homo sapiens
aaagaagagataagccgggtgcg

SEQ ID NO: 46824 - DNA, 24 bp, Homo sapiens
gctgaagaagatggtggcactgtc

SEQ ID NO: 46825 - DNA, 24 bp, Homo sapiens
cggcagcaggagcgacactaccag

SEQ ID NO: 46826 - DNA, 24 bp, Homo sapiens
gggactgtcgtaaaaggggcggga

SEQ ID NO: 46827 - DNA, 24 bp, Homo sapiens
gcggtcgggatgacgtgagctggg

SEQ ID NO: 46828 - DNA, 24 bp, Homo sapiens
agcaggcacaggtcacgatcattg

SEQ ID NO: 46829 - DNA, 23 bp, Homo sapiens
gtgacccaatggctccgatccga

SEQ ID NO: 46830 - DNA, 25 bp, Homo sapiens
ccagctaacattggattcagcacac

SEQ ID NO: 46831 - DNA, 23 bp, Homo sapiens
attcctgccgctgccgccgccgc

SEQ ID NO: 46832 - DNA, 23 bp, Homo sapiens
catggcgcagatcctccctgttc

SEQ ID NO: 46833 - DNA, 25 bp, Homo sapiens
catctgtacgacctagagtctggcg

SEQ ID NO: 46834 - DNA, 25 bp, Homo sapiens
atgaaccgtattagtgctgacacaa

SEQ ID NO: 46835 - DNA, 25 bp, Homo sapiens
cactgctccacacaaaccaacctct

SEQ ID NO: 46836 - DNA, 24 bp, Homo sapiens
ggaagacgaacctacgaagcagag

SEQ ID NO: 46837 - DNA, 24 bp, Homo sapiens
cagcactgcctgcccctccctgtc

SEQ ID NO: 46838 - DNA, 24 bp, Homo sapiens
agtgactgctcttctgcttcaggc

SEQ ID NO: 46839 - DNA, 24 bp, Homo sapiens
gggcagcacaggcagggaaacatg

SEQ ID NO: 46840 - DNA, 24 bp, Homo sapiens
tgggcagcacaggcagggaaacat

SEQ ID NO: 46841 - DNA, 24 bp, Homo sapiens
ctgggcagcacaggcagggaaaca

SEQ ID NO: 46842 - DNA, 24 bp, Homo sapiens
aaagaattagggtaagttttagtt

SEQ ID NO: 46843 - DNA, 24 bp, Homo sapiens
aaaagaattagggtaagttttagt

SEQ ID NO: 46844 - DNA, 24 bp, Homo sapiens
taaaagaattagggtaagttttag

SEQ ID NO: 46845 - DNA, 25 bp, Homo sapiens
aacttcgcacaaatgacaaatgggt

SEQ ID NO: 46846 - DNA, 25 bp, Homo sapiens
gattacagttgctcccaggaccgtg

SEQ ID NO: 46847 - DNA, 25 bp, Homo sapiens
atatcatggacctggctctcagtgc

SEQ ID NO: 46848 - DNA, 23 bp, Homo sapiens
aaccgcagccgagaccacgacta

SEQ ID NO: 46849 - DNA, 23 bp, Homo sapiens
cactgaccgctcgcaggatgatg

SEQ ID NO: 46850 - DNA, 23 bp, Homo sapiens
tggtggtcgtggtgacaggactg

SEQ ID NO: 46851 - DNA, 24 bp, Homo sapiens
acagcagccgcctcagcaacagtt

SEQ ID NO: 46852 - DNA, 24 bp, Homo sapiens
ccagaggctgaggaggtccaggag

SEQ ID NO: 46853 - DNA, 24 bp, Homo sapiens
ccagcacccaggagaaccagaatg

SEQ ID NO: 46854 - DNA, 24 bp, Homo sapiens
aggacgggcaggtcacactggcgg

SEQ ID NO: 46855 - DNA, 24 bp, Homo sapiens
aaggacgggcaggtcacactggcg

SEQ ID NO: 46856 - DNA, 24 bp, Homo sapiens
gaaggacgggcaggtcacactggc

SEQ ID NO: 46857 - DNA, 24 bp, Homo sapiens
ggtccttcttgagcagatgggcag

SEQ ID NO: 46858 - DNA, 24 bp, Homo sapiens
ctgggtgtagaggtgcctgaagcc

SEQ ID NO: 46859 - DNA, 24 bp, Homo sapiens
cttcagcagcaggtggagcaggcg

SEQ ID NO: 46860 - DNA, 24 bp, Homo sapiens
ctgggtgtagaggtgcctgaagcc

SEQ ID NO: 46861 - DNA, 24 bp, Homo sapiens
cttcagcagcaggtggagcaggcg

SEQ ID NO: 46862 - DNA, 24 bp, Homo sapiens
tgccaagatagcctccagcccttc

SEQ ID NO: 46863 - DNA, 24 bp, Homo sapiens
gcataagaaagattgactcatata

SEQ ID NO: 46864 - DNA, 24 bp, Homo sapiens
tgcataagaaagattgactcatat

SEQ ID NO: 46865 - DNA, 24 bp, Homo sapiens
gtgcataagaaagattgactcata

SEQ ID NO: 46866 - DNA, 24 bp, Homo sapiens
gggcagcacaggcaggaaaacatg

SEQ ID NO: 46867 - DNA, 24 bp, Homo sapiens
tgggcagcacaggcaggaaaacat

SEQ ID NO: 46868 - DNA, 24 bp, Homo sapiens
ctgggcagcacaggcaggaaaaca

SEQ ID NO: 46869 - DNA, 24 bp, Homo sapiens
ccataacacagattaaccaagtta

SEQ ID NO: 46870 - DNA, 24 bp, Homo sapiens
cccataacacagattaaccaagtt

SEQ ID NO: 46871 - DNA, 24 bp, Homo sapiens
ccccataacacagattaaccaagt

SEQ ID NO: 46872 - DNA, 24 bp, Homo sapiens
tgccaatttaggtaagaatttttc

SEQ ID NO: 46873 - DNA, 24 bp, Homo sapiens
atgccaatttaggtaagaattttt

SEQ ID NO: 46874 - DNA, 24 bp, Homo sapiens
tatgccaatttaggtaagaatttt

SEQ ID NO: 46875 - DNA, 24 bp, Homo sapiens
tggcccacaaggtcagtatactac

SEQ ID NO: 46876 - DNA, 24 bp, Homo sapiens
atggcccacaaggtcagtatacta

SEQ ID NO: 46877 - DNA, 24 bp, Homo sapiens
tatggcccacaaggtcagtatact

SEQ ID NO: 46878 - DNA, 24 bp, Homo sapiens
acatggcgaaaccccatttctact

SEQ ID NO: 46879 - DNA, 24 bp, Homo sapiens
aacatggcgaaaccccatttctac

SEQ ID NO: 46880 - DNA, 24 bp, Homo sapiens
caacatggcgaaaccccatttcta

SEQ ID NO: 46881 - DNA, 24 bp, Homo sapiens
ccagccaccaggtcctccgcgaca

SEQ ID NO: 46882 - DNA, 24 bp, Homo sapiens
gccagccaccaggtcctccgcgac

SEQ ID NO: 46883 - DNA, 24 bp, Homo sapiens
agccagccaccaggtcctccgcga

SEQ ID NO: 46884 - DNA, 24 bp, Homo sapiens
ctacaaagcccaggacactccagc

SEQ ID NO: 46885 - DNA, 24 bp, Homo sapiens
ctgctgtcattaaggacctgcggc

SEQ ID NO: 46886 - DNA, 24 bp, Homo sapiens
gcttgatccgccactatacgatgg

SEQ ID NO: 46887 - DNA, 25 bp, Homo sapiens
ggagaggtgccttctgccatgattg

SEQ ID NO: 46888 - DNA, 25 bp, Homo sapiens
gccttcccagccattcagaactcat

SEQ ID NO: 46889 - DNA, 25 bp, Homo sapiens
accagtgaatcgccttccaaaccag

SEQ ID NO: 46890 - DNA, 24 bp, Homo sapiens
aggacttcaccaagggtttcagcc

SEQ ID NO: 46891 - DNA, 24 bp, Homo sapiens
cttgctgagcgtgctcctgaactg

SEQ ID NO: 46892 - DNA, 24 bp, Homo sapiens
gtctctaccttggtggatgatacg

SEQ ID NO: 46893 - DNA, 24 bp, Homo sapiens
taaaacttttggtaagcagttttg

SEQ ID NO: 46894 - DNA, 24 bp, Homo sapiens
ctaaaacttttggtaagcagtttt

SEQ ID NO: 46895 - DNA, 24 bp, Homo sapiens
gctaaaacttttggtaagcagttt

SEQ ID NO: 46896 - DNA, 24 bp, Homo sapiens
cgcacacggttagaagaggagata

SEQ ID NO: 46897 - DNA, 24 bp, Homo sapiens
gacagtgatgggtcagagccttct

SEQ ID NO: 46898 - DNA, 24 bp, Homo sapiens
ggatgaagaggaggatgaagagca

SEQ ID NO: 46899 - DNA, 24 bp, Homo sapiens
tttatccatagataatgtttcttg

SEQ ID NO: 46900 - DNA, 24 bp, Homo sapiens
ctttatccatagataatgtttctt

SEQ ID NO: 46901 - DNA, 24 bp, Homo sapiens
gctttatccatagataatgtttct

SEQ ID NO: 46902 - DNA, 23 bp, Homo sapiens
ggagcaggcggcggcggtggcga

SEQ ID NO: 46903 - DNA, 23 bp, Homo sapiens
cccgagccgagccgcctgcgccc

SEQ ID NO: 46904 - DNA, 23 bp, Homo sapiens
gagccctaggctcggcgctgccg

SEQ ID NO: 46905 - DNA, 23 bp, Homo sapiens
aaggcttccctcccctcccctcc

SEQ ID NO: 46906 - DNA, 23 bp, Homo sapiens
tccgatttggagggaagcggttg

SEQ ID NO: 46907 - DNA, 23 bp, Homo sapiens
cacgttgcaaggcccatgtcacc

SEQ ID NO: 46908 - DNA, 25 bp, Homo sapiens
tgtattcacaagtcttccaagcgac

SEQ ID NO: 46909 - DNA, 23 bp, Homo sapiens
cgtcggctgtcaccaccttcaac

SEQ ID NO: 46910 - DNA, 24 bp, Homo sapiens
aggatggtgctggagttcaagtgc

SEQ ID NO: 46911 - DNA, 24 bp, Homo sapiens
aagaaaaacagattttaaatggct

SEQ ID NO: 46912 - DNA, 24 bp, Homo sapiens
aaagaaaaacagattttaaatggc

SEQ ID NO: 46913 - DNA, 24 bp, Homo sapiens
taaagaaaaacagattttaaatgg

SEQ ID NO: 46914 - DNA, 24 bp, Homo sapiens
tttaaaactagattcacctggtaa

SEQ ID NO: 46915 - DNA, 24 bp, Homo sapiens
ttttaaaactagattcacctggta

SEQ ID NO: 46916 - DNA, 24 bp, Homo sapiens
tttttaaaactagattcacctggt

SEQ ID NO: 46917 - DNA, 24 bp, Homo sapiens
tcttcaaactgattcacctggtaa

SEQ ID NO: 46918 - DNA, 24 bp, Homo sapiens
ttcttcaaactgattcacctggta

SEQ ID NO: 46919 - DNA, 24 bp, Homo sapiens
tttcttcaaactgattcacctggt

SEQ ID NO: 46920 - DNA, 25 bp, Homo sapiens
gcactatctccagactaccatcacc

SEQ ID NO: 46921 - DNA, 23 bp, Homo sapiens
gaagtcagccgcctgccaggatg

SEQ ID NO: 46922 - DNA, 23 bp, Homo sapiens
cagctggacaaagctctgcagaa

SEQ ID NO: 46923 - DNA, 24 bp, Homo sapiens
taatagacaggattcacaaggatg

SEQ ID NO: 46924 - DNA, 24 bp, Homo sapiens
ttaatagacaggattcacaaggat

SEQ ID NO: 46925 - DNA, 24 bp, Homo sapiens
tttaatagacaggattcacaagga

SEQ ID NO: 46926 - DNA, 24 bp, Homo sapiens
cttcagtgaatgtgtccgtgaggc

SEQ ID NO: 46927 - DNA, 23 bp, Homo sapiens
caggagcagggcaaacgcaagat

SEQ ID NO: 46928 - DNA, 25 bp, Homo sapiens
gcagtgctgacatcagtgagttgtt

SEQ ID NO: 46929 - DNA, 23 bp, Homo sapiens
gggaaaggactgagaagacgcca

SEQ ID NO: 46930 - DNA, 23 bp, Homo sapiens
ctatcctggtgccacctgggagg

SEQ ID NO: 46931 - DNA, 23 bp, Homo sapiens
ggctcctgctgctgctggggctg

SEQ ID NO: 46932 - DNA, 24 bp, Homo sapiens
aagtcaacgcaagcaaaggggagt

SEQ ID NO: 46933 - DNA, 23 bp, Homo sapiens
ttagaagcagccgaagcagcgtg

SEQ ID NO: 46934 - DNA, 24 bp, Homo sapiens
cacgatttgaacgctctgccttgc

SEQ ID NO: 46935 - DNA, 24 bp, Homo sapiens
tgctgagccaggagactgagggct

SEQ ID NO: 46936 - DNA, 24 bp, Homo sapiens
gtgctgagccaggagactgagggc

SEQ ID NO: 46937 - DNA, 24 bp, Homo sapiens
tgtgctgagccaggagactgaggg

SEQ ID NO: 46938 - DNA, 24 bp, Homo sapiens
tatatttgcagattcttggatgaa

SEQ ID NO: 46939 - DNA, 24 bp, Homo sapiens
gtatatttgcagattcttggatga

SEQ ID NO: 46940 - DNA, 24 bp, Homo sapiens
agtatatttgcagattcttggatg

SEQ ID NO: 46941 - DNA, 25 bp, Homo sapiens
agaatgaccttgggctatgttggca

SEQ ID NO: 46942 - DNA, 25 bp, Homo sapiens
tgctaatcttccctggaatgaaacc

SEQ ID NO: 46943 - DNA, 25 bp, Homo sapiens
ggattattaggctgggtgtggtggc

SEQ ID NO: 46944 - DNA, 25 bp, Homo sapiens
aaagtgctgggattacaggcgtgag

SEQ ID NO: 46945 - DNA, 23 bp, Homo sapiens
acctcgtgatccgcccgcctcag

SEQ ID NO: 46946 - DNA, 23 bp, Homo sapiens
cgcccggcttgttccttcttttg

SEQ ID NO: 46947 - DNA, 24 bp, Homo sapiens
taaatggactggaggcagtagggg

SEQ ID NO: 46948 - DNA, 24 bp, Homo sapiens
ttaaatggactggaggcagtaggg

SEQ ID NO: 46949 - DNA, 24 bp, Homo sapiens
cttaaatggactggaggcagtagg

SEQ ID NO: 46950 - DNA, 24 bp, Homo sapiens
gtagccaggatggtctcgatctcc

SEQ ID NO: 46951 - DNA, 23 bp, Homo sapiens
catgatccgcctgcctcggcctc

SEQ ID NO: 46952 - DNA, 23 bp, Homo sapiens
cctgggcaaaatttgatatttgt

SEQ ID NO: 46953 - DNA, 23 bp, Homo sapiens
acctttgtcgctcggctctgggc

SEQ ID NO: 46954 - DNA, 25 bp, Homo sapiens
actgcttcaacatctccatctccgc

SEQ ID NO: 46955 - DNA, 23 bp, Homo sapiens
ggagtggcagtggaagcggcagc

SEQ ID NO: 46956 - DNA, 24 bp, Homo sapiens
tctcatctcatcctaattttaaag

SEQ ID NO: 46957 - DNA, 24 bp, Homo sapiens
atctcatctcatcctaattttaaa

SEQ ID NO: 46958 - DNA, 24 bp, Homo sapiens
tatctcatctcatcctaattttaa

SEQ ID NO: 46959 - DNA, 25 bp, Homo sapiens
tggctacacgagtaagttcttcagt

SEQ ID NO: 46960 - DNA, 23 bp, Homo sapiens
gcacccatcacccgagcagtata

SEQ ID NO: 46961 - DNA, 25 bp, Homo sapiens
tctctgtggatttgcctattctgga

SEQ ID NO: 46962 - DNA, 24 bp, Homo sapiens
ctattaacacacctaattttaaag

SEQ ID NO: 46963 - DNA, 24 bp, Homo sapiens
actattaacacacctaattttaaa

SEQ ID NO: 46964 - DNA, 24 bp, Homo sapiens
aactattaacacacctaattttaa

SEQ ID NO: 46965 - DNA, 24 bp, Homo sapiens
catttcattaggagagacaataga

SEQ ID NO: 46966 - DNA, 24 bp, Homo sapiens
ccatttcattaggagagacaatag

SEQ ID NO: 46967 - DNA, 24 bp, Homo sapiens
tccatttcattaggagagacaata

SEQ ID NO: 46968 - DNA, 24 bp, Homo sapiens
taaggaacaagataattatactgg

SEQ ID NO: 46969 - DNA, 24 bp, Homo sapiens
ctaaggaacaagataattatactg

SEQ ID NO: 46970 - DNA, 24 bp, Homo sapiens
gctaaggaacaagataattatact

SEQ ID NO: 46971 - DNA, 24 bp, Homo sapiens
aattaaagcagggactgagacagc

SEQ ID NO: 46972 - DNA, 24 bp, Homo sapiens
taattaaagcagggactgagacag

SEQ ID NO: 46973 - DNA, 24 bp, Homo sapiens
ataattaaagcagggactgagaca

SEQ ID NO: 46974 - DNA, 23 bp, Homo sapiens
atctcctgacctcgtgatccgcc

SEQ ID NO: 46975 - DNA, 25 bp, Homo sapiens
cctacatagcatccagcgacaccac

SEQ ID NO: 46976 - DNA, 23 bp, Homo sapiens
gcggaactgcgggagagaagaac

SEQ ID NO: 46977 - DNA, 23 bp, Homo sapiens
gagatgtgactgctgctggctgg

SEQ ID NO: 46978 - DNA, 23 bp, Homo sapiens
cagaggacagcatcactggcacc

SEQ ID NO: 46979 - DNA, 25 bp, Homo sapiens
tctgtctccactcaagaggctgatg

SEQ ID NO: 46980 - DNA, 23 bp, Homo sapiens
acagccagccgcaagtccaccta

SEQ ID NO: 46981 - DNA, 25 bp, Homo sapiens
gccatattcttattgcctgctgtct

SEQ ID NO: 46982 - DNA, 23 bp, Homo sapiens
ttgggcttgaacatcgtcagtgc

SEQ ID NO: 46983 - DNA, 25 bp, Homo sapiens
tgaggatggtgagtggtggatagcc

SEQ ID NO: 46984 - DNA, 25 bp, Homo sapiens
acgaagtcaggtgtatccaacagcc

SEQ ID NO: 46985 - DNA, 23 bp, Homo sapiens
ggctcagagtaaccacagtgctg

SEQ ID NO: 46986 - DNA, 24 bp, Homo sapiens
tcctgggctgaaagttgcttgtgg

SEQ ID NO: 46987 - DNA, 25 bp, Homo sapiens
attggacagaatttgggagcacact

SEQ ID NO: 46988 - DNA, 24 bp, Homo sapiens
agtaacagaatcggttgtgccatt

SEQ ID NO: 46989 - DNA, 24 bp, Homo sapiens
cgttccttgtctgcctcgctttct

SEQ ID NO: 46990 - DNA, 23 bp, Homo sapiens
gccctccgcctgctcccagccat

SEQ ID NO: 46991 - DNA, 23 bp, Homo sapiens
cgctctcgcgctaactgtgctcc

SEQ ID NO: 46992 - DNA, 25 bp, Homo sapiens
tcaggaccccaaaatcactaagcca

SEQ ID NO: 46993 - DNA, 23 bp, Homo sapiens
gctcctgttggccatgtgaaagg

SEQ ID NO: 46994 - DNA, 23 bp, Homo sapiens
gagaggagcaggtgaagcagtgg

SEQ ID NO: 46995 - DNA, 23 bp, Homo sapiens
catggatcagagctgcctgtcag

SEQ ID NO: 46996 - DNA, 23 bp, Homo sapiens
cacctctggctcctcggaccttc

SEQ ID NO: 46997 - DNA, 24 bp, Homo sapiens
attacagcaagtataagaatgcgg

SEQ ID NO: 46998 - DNA, 24 bp, Homo sapiens
tattacagcaagtataagaatgcg

SEQ ID NO: 46999 - DNA, 24 bp, Homo sapiens
ctattacagcaagtataagaatgc

SEQ ID NO: 47000 - DNA, 23 bp, Homo sapiens
cctggaggtgcggctgaccaacc

SEQ ID NO: 47001 - DNA, 23 bp, Homo sapiens
cttccaggaccaccagaacggcg

SEQ ID NO: 47002 - DNA, 23 bp, Homo sapiens
ggctccagcaccttctacctcga

SEQ ID NO: 47003 - DNA, 23 bp, Homo sapiens
tgccaagacctcagttacctcct

SEQ ID NO: 47004 - DNA, 23 bp, Homo sapiens
gtggagagtggcaggaagcaagc

SEQ ID NO: 47005 - DNA, 23 bp, Homo sapiens
gcacttaggaaaggctggtgagc

SEQ ID NO: 47006 - DNA, 25 bp, Homo sapiens
agacagagacgacattgacttaggc

SEQ ID NO: 47007 - DNA, 23 bp, Homo sapiens
catccttgctgccgccacctgag

SEQ ID NO: 47008 - DNA, 25 bp, Homo sapiens
ccctcaagtgtgtaaagaccagccg

SEQ ID NO: 47009 - DNA, 23 bp, Homo sapiens
gtgtggctgtgctgatgctactc

SEQ ID NO: 47010 - DNA, 25 bp, Homo sapiens
cgcttggactgccttggtatgtctc

SEQ ID NO: 47011 - DNA, 24 bp, Homo sapiens
tggctcacatggacagtcttcgga

SEQ ID NO: 47012 - DNA, 24 bp, Homo sapiens
tgccaggaaagcagcagccgcagc

SEQ ID NO: 47013 - DNA, 24 bp, Homo sapiens
ttgccaggaaagcagcagccgcag

SEQ ID NO: 47014 - DNA, 24 bp, Homo sapiens
cttgccaggaaagcagcagccgca

SEQ ID NO: 47015 - DNA, 24 bp, Homo sapiens
aggccaagcagctcaccccacgga

SEQ ID NO: 47016 - DNA, 24 bp, Homo sapiens
aaggccaagcagctcaccccacgg

SEQ ID NO: 47017 - DNA, 24 bp, Homo sapiens
caaggccaagcagctcaccccacg

SEQ ID NO: 47018 - DNA, 24 bp, Homo sapiens
agatgagggagaagccaggacgag

SEQ ID NO: 47019 - DNA, 23 bp, Homo sapiens
aggctcggcacctccaaggactt

SEQ ID NO: 47020 - DNA, 23 bp, Homo sapiens
cgcagtgtgatccaaagacgcct

SEQ ID NO: 47021 - DNA, 24 bp, Homo sapiens
tcgtgtggttggtgagctgcaccg

SEQ ID NO: 47022 - DNA, 24 bp, Homo sapiens
atcgtgtggttggtgagctgcacc

SEQ ID NO: 47023 - DNA, 24 bp, Homo sapiens
catcgtgtggttggtgagctgcac

SEQ ID NO: 47024 - DNA, 23 bp, Homo sapiens
ctcggctgacctgtggggcggga

SEQ ID NO: 47025 - DNA, 23 bp, Homo sapiens
gtccgagcaggacaaagacggcg

SEQ ID NO: 47026 - DNA, 23 bp, Homo sapiens
agctggctgctgctgcacggcgg

SEQ ID NO: 47027 - DNA, 23 bp, Homo sapiens
cgctgctaccgcgtctgctggac

SEQ ID NO: 47028 - DNA, 23 bp, Homo sapiens
tgtgcccgctgtgcctgctgtgc

SEQ ID NO: 47029 - DNA, 23 bp, Homo sapiens
cggctgctcccattgagctgtct

SEQ ID NO: 47030 - DNA, 23 bp, Homo sapiens
cactcccaggccagcccaccccg

SEQ ID NO: 47031 - DNA, 23 bp, Homo sapiens
gggggacggcgcccgccaggagc

SEQ ID NO: 47032 - DNA, 24 bp, Homo sapiens
aaagactagaggcagcgctgacca

SEQ ID NO: 47033 - DNA, 24 bp, Homo sapiens
gaaagactagaggcagcgctgacc

SEQ ID NO: 47034 - DNA, 24 bp, Homo sapiens
agaaagactagaggcagcgctgac

SEQ ID NO: 47035 - DNA, 24 bp, Homo sapiens
gttatttctagtgaaaacagagac

SEQ ID NO: 47036 - DNA, 24 bp, Homo sapiens
tgttatttctagtgaaaacagaga

SEQ ID NO: 47037 - DNA, 24 bp, Homo sapiens
ttgttatttctagtgaaaacagag

SEQ ID NO: 47038 - DNA, 24 bp, Homo sapiens
agttattaaagttatcatttaaca

SEQ ID NO: 47039 - DNA, 24 bp, Homo sapiens
cagttattaaagttatcatttaac

SEQ ID NO: 47040 - DNA, 24 bp, Homo sapiens
acagttattaaagttatcatttaa

SEQ ID NO: 47041 - DNA, 24 bp, Homo sapiens
ttaggaattgcggcacgaagaatg

SEQ ID NO: 47042 - DNA, 25 bp, Homo sapiens
ggctgaatctacctctgagttatgc

SEQ ID NO: 47043 - DNA, 25 bp, Homo sapiens
tcacatcatggctgagcattgtagg

SEQ ID NO: 47044 - DNA, 24 bp, Homo sapiens
aggaattagaggtaatgaattttc

SEQ ID NO: 47045 - DNA, 24 bp, Homo sapiens
aaggaattagaggtaatgaatttt

SEQ ID NO: 47046 - DNA, 24 bp, Homo sapiens
aaaggaattagaggtaatgaattt

SEQ ID NO: 47047 - DNA, 25 bp, Homo sapiens
gtcaacggtgctgtctccctttctt

SEQ ID NO: 47048 - DNA, 25 bp, Homo sapiens
tttgctgtattaactgctcctgggc

SEQ ID NO: 47049 - DNA, 25 bp, Homo sapiens
acccattggctgtgttctgtttgaa

SEQ ID NO: 47050 - DNA, 23 bp, Homo sapiens
gctgacgcctccatccgcatctg

SEQ ID NO: 47051 - DNA, 23 bp, Homo sapiens
caccacagccaccgcccatgatg

SEQ ID NO: 47052 - DNA, 25 bp, Homo sapiens
ccttcggcagttcaagtctggttcc

SEQ ID NO: 47053 - DNA, 24 bp, Homo sapiens
caagatgtcaggttagcagagccc

SEQ ID NO: 47054 - DNA, 24 bp, Homo sapiens
tcaagatgtcaggttagcagagcc

SEQ ID NO: 47055 - DNA, 24 bp, Homo sapiens
atcaagatgtcaggttagcagagc

SEQ ID NO: 47056 - DNA, 24 bp, Homo sapiens
gagataaagagactcaaaaaaatg

SEQ ID NO: 47057 - DNA, 24 bp, Homo sapiens
agagataaagagactcaaaaaaat

SEQ ID NO: 47058 - DNA, 24 bp, Homo sapiens
aagagataaagagactcaaaaaaa

SEQ ID NO: 47059 - DNA, 24 bp, Homo sapiens
gttcaacggcagcctcaggacaga

SEQ ID NO: 47060 - DNA, 24 bp, Homo sapiens
tggacatggagtacgacctgaagc

SEQ ID NO: 47061 - DNA, 24 bp, Homo sapiens
gctcagtgcccaggctccacgacg

SEQ ID NO: 47062 - DNA, 24 bp, Homo sapiens
ttccactcctgctgctacgactgt

SEQ ID NO: 47063 - DNA, 24 bp, Homo sapiens
gctgtgctgctgctgctcctgctg

SEQ ID NO: 47064 - DNA, 24 bp, Homo sapiens
gggctgttcgttcaccatcgggac

SEQ ID NO: 47065 - DNA, 24 bp, Homo sapiens
agagtttcaaggtaggataattgc

SEQ ID NO: 47066 - DNA, 24 bp, Homo sapiens
cagagtttcaaggtaggataattg

SEQ ID NO: 47067 - DNA, 24 bp, Homo sapiens
acagagtttcaaggtaggataatt

SEQ ID NO: 47068 - DNA, 24 bp, Homo sapiens
gaaacacgaaggtatgaagagcta

SEQ ID NO: 47069 - DNA, 24 bp, Homo sapiens
ggaaacacgaaggtatgaagagct

SEQ ID NO: 47070 - DNA, 24 bp, Homo sapiens
tggaaacacgaaggtatgaagagc

SEQ ID NO: 47071 - DNA, 24 bp, Homo sapiens
tggagaactacacctgcctggacc

SEQ ID NO: 47072 - DNA, 23 bp, Homo sapiens
gagaggcaggcggaggctcagtc

SEQ ID NO: 47073 - DNA, 24 bp, Homo sapiens
gcctatgtctgctacctgctgctc

SEQ ID NO: 47074 - DNA, 25 bp, Homo sapiens
gaatatagagccgccagccagaagc

SEQ ID NO: 47075 - DNA, 23 bp, Homo sapiens
ccgaagtggtgtcaactcctggc

SEQ ID NO: 47076 - DNA, 25 bp, Homo sapiens
atgtagtgctgctgcctggtaagaa

SEQ ID NO: 47077 - DNA, 24 bp, Homo sapiens
aaggaaaatatgtaagtatgcacc

SEQ ID NO: 47078 - DNA, 24 bp, Homo sapiens
aaaggaaaatatgtaagtatgcac

SEQ ID NO: 47079 - DNA, 24 bp, Homo sapiens
taaaggaaaatatgtaagtatgca

SEQ ID NO: 47080 - DNA, 23 bp, Homo sapiens
aggctgaggagaggaggaagacc

SEQ ID NO: 47081 - DNA, 24 bp, Homo sapiens
cgcccaaggacaaatggagcaact

SEQ ID NO: 47082 - DNA, 23 bp, Homo sapiens
atgtcgtggctcttcggcgttaa

SEQ ID NO: 47083 - DNA, 24 bp, Homo sapiens
gagaagaaaaaatattgagatagg

SEQ ID NO: 47084 - DNA, 24 bp, Homo sapiens
cgagaagaaaaaatattgagatag

SEQ ID NO: 47085 - DNA, 24 bp, Homo sapiens
ccgagaagaaaaaatattgagata

SEQ ID NO: 47086 - DNA, 24 bp, Homo sapiens
aggcaggatgaacattctggcacc

SEQ ID NO: 47087 - DNA, 23 bp, Homo sapiens
tggaacgatttgaggtgctgggc

SEQ ID NO: 47088 - DNA, 25 bp, Homo sapiens
agccatcatcattgtcttcaacctg

SEQ ID NO: 47089 - DNA, 24 bp, Homo sapiens
cacatgtgtagatattgatgaatg

SEQ ID NO: 47090 - DNA, 24 bp, Homo sapiens
acacatgtgtagatattgatgaat

SEQ ID NO: 47091 - DNA, 24 bp, Homo sapiens
gacacatgtgtagatattgatgaa

SEQ ID NO: 47092 - DNA, 24 bp, Homo sapiens
gcatgttcatggtaatgtaatttc

SEQ ID NO: 47093 - DNA, 24 bp, Homo sapiens
tgcatgttcatggtaatgtaattt

SEQ ID NO: 47094 - DNA, 24 bp, Homo sapiens
ctgcatgttcatggtaatgtaatt

SEQ ID NO: 47095 - DNA, 24 bp, Homo sapiens
ttcagtattaggtacttatatagt

SEQ ID NO: 47096 - DNA, 24 bp, Homo sapiens
tttcagtattaggtacttatatag

SEQ ID NO: 47097 - DNA, 24 bp, Homo sapiens
ctttcagtattaggtacttatata

SEQ ID NO: 47098 - DNA, 25 bp, Homo sapiens
cctcttcctgtaatcacctggtcca

SEQ ID NO: 47099 - DNA, 25 bp, Homo sapiens
agcaccatgttagcaatccagacgg

SEQ ID NO: 47100 - DNA, 23 bp, Homo sapiens
cgaccaagccacgccctcagatg

SEQ ID NO: 47101 - DNA, 24 bp, Homo sapiens
cctgagaaggtcaaagcctgccag

SEQ ID NO: 47102 - DNA, 23 bp, Homo sapiens
gagaccatcgagcgactgcggag

SEQ ID NO: 47103 - DNA, 23 bp, Homo sapiens
gggtggggctggtgctgctgaag

SEQ ID NO: 47104 - DNA, 24 bp, Homo sapiens
ccagtacgagaccatcgagcgact

SEQ ID NO: 47105 - DNA, 24 bp, Homo sapiens
ctcccctgagaaggtcaaagcctg

SEQ ID NO: 47106 - DNA, 23 bp, Homo sapiens
gggtggggctggtgctgctgaag

SEQ ID NO: 47107 - DNA, 24 bp, Homo sapiens
tcttttccaaggtctgacacaaaa

SEQ ID NO: 47108 - DNA, 24 bp, Homo sapiens
ttcttttccaaggtctgacacaaa

SEQ ID NO: 47109 - DNA, 24 bp, Homo sapiens
tttcttttccaaggtctgacacaa

SEQ ID NO: 47110 - DNA, 24 bp, Homo sapiens
ttattagatgaggtgatgctatta

SEQ ID NO: 47111 - DNA, 24 bp, Homo sapiens
tttattagatgaggtgatgctatt

SEQ ID NO: 47112 - DNA, 24 bp, Homo sapiens
ctttattagatgaggtgatgctat

SEQ ID NO: 47113 - DNA, 24 bp, Homo sapiens
gtgaattacagacctgatgaattt

SEQ ID NO: 47114 - DNA, 24 bp, Homo sapiens
ggtgaattacagacctgatgaatt

SEQ ID NO: 47115 - DNA, 24 bp, Homo sapiens
tggtgaattacagacctgatgaat

SEQ ID NO: 47116 - DNA, 25 bp, Homo sapiens
tggaggaggaggaggaagaggataa

SEQ ID NO: 47117 - DNA, 24 bp, Homo sapiens
gctcgtcctcttaccaggtcaagg

SEQ ID NO: 47118 - DNA, 24 bp, Homo sapiens
ccaggctccgactcacaatcaagg

SEQ ID NO: 47119 - DNA, 23 bp, Homo sapiens
ttctgttccagcgtcaaggatgg

SEQ ID NO: 47120 - DNA, 23 bp, Homo sapiens
ccagcagcccagccacagaggag

SEQ ID NO: 47121 - DNA, 23 bp, Homo sapiens
aacctctcccggcgcctgttctg

SEQ ID NO: 47122 - DNA, 24 bp, Homo sapiens
agaaacacatgggatgaataacag

SEQ ID NO: 47123 - DNA, 24 bp, Homo sapiens
gagaaacacatgggatgaataaca

SEQ ID NO: 47124 - DNA, 24 bp, Homo sapiens
ggagaaacacatgggatgaataac

SEQ ID NO: 47125 - DNA, 23 bp, Homo sapiens
atcctgtttgccctcgtctgccg

SEQ ID NO: 47126 - DNA, 23 bp, Homo sapiens
cccagccgcccgacttcgccgcc

SEQ ID NO: 47127 - DNA, 23 bp, Homo sapiens
gccggctggccgcgacctcagcc

SEQ ID NO: 47128 - DNA, 24 bp, Homo sapiens
gaatataaaaggcaagctctaaat

SEQ ID NO: 47129 - DNA, 24 bp, Homo sapiens
tgaatataaaaggcaagctctaaa

SEQ ID NO: 47130 - DNA, 24 bp, Homo sapiens
ttgaatataaaaggcaagctctaa

SEQ ID NO: 47131 - DNA, 24 bp, Homo sapiens
attctaaaatgggatactacaaca

SEQ ID NO: 47132 - DNA, 24 bp, Homo sapiens
cattctaaaatgggatactacaac

SEQ ID NO: 47133 - DNA, 24 bp, Homo sapiens
tcattctaaaatgggatactacaa

SEQ ID NO: 47134 - DNA, 25 bp, Homo sapiens
cttacagccttagccagacagaagc

SEQ ID NO: 47135 - DNA, 25 bp, Homo sapiens
agaggaagttgctgcttataggaac

SEQ ID NO: 47136 - DNA, 25 bp, Homo sapiens
gtgtggacatgctgcgagatggtta

SEQ ID NO: 47137 - DNA, 23 bp, Homo sapiens
ggactgacttcggcggaacggaa

SEQ ID NO: 47138 - DNA, 23 bp, Homo sapiens
ccaggcttcggaatcactgagag

SEQ ID NO: 47139 - DNA, 23 bp, Homo sapiens
gccaacgcccagcacctgccgcc

SEQ ID NO: 47140 - DNA, 24 bp, Homo sapiens
aattcatgaggtgtcaactgttag

SEQ ID NO: 47141 - DNA, 24 bp, Homo sapiens
aaattcatgaggtgtcaactgtta

SEQ ID NO: 47142 - DNA, 24 bp, Homo sapiens
aaaattcatgaggtgtcaactgtt

SEQ ID NO: 47143 - DNA, 23 bp, Homo sapiens
gctgcaatgagctcggcctcggg

SEQ ID NO: 47144 - DNA, 23 bp, Homo sapiens
ggagggcaaggtgtctggctgcg

SEQ ID NO: 47145 - DNA, 23 bp, Homo sapiens
gggcccgggagcctgtggcttca

SEQ ID NO: 47146 - DNA, 24 bp, Homo sapiens
cttttgttaaagtaagtgtttgaa

SEQ ID NO: 47147 - DNA, 24 bp, Homo sapiens
acttttgttaaagtaagtgtttga

SEQ ID NO: 47148 - DNA, 24 bp, Homo sapiens
tacttttgttaaagtaagtgtttg

SEQ ID NO: 47149 - DNA, 25 bp, Homo sapiens
tgcctccaggttcaagtgattctcc

SEQ ID NO: 47150 - DNA, 24 bp, Homo sapiens
gcactaccactcctgtctaatgtt

SEQ ID NO: 47151 - DNA, 23 bp, Homo sapiens
gcagtggcaccatctcagctcac

SEQ ID NO: 47152 - DNA, 24 bp, Homo sapiens
gctcacgccattctcctgccttag

SEQ ID NO: 47153 - DNA, 23 bp, Homo sapiens
aggctggagtggagtggcacgat

SEQ ID NO: 47154 - DNA, 24 bp, Homo sapiens
gcttcagccttctacctggttctt

SEQ ID NO: 47155 - DNA, 24 bp, Homo sapiens
caacaattttaacacaattgcaaa

SEQ ID NO: 47156 - DNA, 24 bp, Homo sapiens
acaacaattttaacacaattgcaa

SEQ ID NO: 47157 - DNA, 24 bp, Homo sapiens
aacaacaattttaacacaattgca

SEQ ID NO: 47158 - DNA, 24 bp, Homo sapiens
tctttttctagcaaaaaatggccc

SEQ ID NO: 47159 - DNA, 24 bp, Homo sapiens
ttctttttctagcaaaaaatggcc

SEQ ID NO: 47160 - DNA, 24 bp, Homo sapiens
attctttttctagcaaaaaatggc

SEQ ID NO: 47161 - DNA, 24 bp, Homo sapiens
acaaacaaatggtatcctcatatt

SEQ ID NO: 47162 - DNA, 24 bp, Homo sapiens
cacaaacaaatggtatcctcatat

SEQ ID NO: 47163 - DNA, 24 bp, Homo sapiens
gcacaaacaaatggtatcctcata

SEQ ID NO: 47164 - DNA, 24 bp, Homo sapiens
actcaactcaagtaaggaaatttg

SEQ ID NO: 47165 - DNA, 24 bp, Homo sapiens
tactcaactcaagtaaggaaattt

SEQ ID NO: 47166 - DNA, 24 bp, Homo sapiens
atactcaactcaagtaaggaaatt

SEQ ID NO: 47167 - DNA, 24 bp, Homo sapiens
catttacaaagttacagatgatgt

SEQ ID NO: 47168 - DNA, 24 bp, Homo sapiens
tcatttacaaagttacagatgatg

SEQ ID NO: 47169 - DNA, 24 bp, Homo sapiens
ttcatttacaaagttacagatgat

SEQ ID NO: 47170 - DNA, 24 bp, Homo sapiens
atgattacttgaatttaaaccaga

SEQ ID NO: 47171 - DNA, 24 bp, Homo sapiens
gatgattacttgaatttaaaccag

SEQ ID NO: 47172 - DNA, 24 bp, Homo sapiens
tgatgattacttgaatttaaacca

SEQ ID NO: 47173 - DNA, 25 bp, Homo sapiens
gtccttacccagaaccctcacagtc

SEQ ID NO: 47174 - DNA, 23 bp, Homo sapiens
gctcaggaggcagaaagggtcac

SEQ ID NO: 47175 - DNA, 23 bp, Homo sapiens
cccagagagaaatccaggaccct

SEQ ID NO: 47176 - DNA, 23 bp, Homo sapiens
gcctgtccctgttgctgctgccg

SEQ ID NO: 47177 - DNA, 23 bp, Homo sapiens
ctgctgctgctgtgtgccttcgg

SEQ ID NO: 47178 - DNA, 25 bp, Homo sapiens
tccctgccctacatgaagatgatct

SEQ ID NO: 47179 - DNA, 23 bp, Homo sapiens
ctgctgctgctgtgtgccttcgg

SEQ ID NO: 47180 - DNA, 23 bp, Homo sapiens
cccatccgctatatcctgctgcc

SEQ ID NO: 47181 - DNA, 24 bp, Homo sapiens
ttggatgtcatggacgctgagcac

SEQ ID NO: 47182 - DNA, 23 bp, Homo sapiens
ctgctgctgctgtgtgccttcgg

SEQ ID NO: 47183 - DNA, 25 bp, Homo sapiens
tccctgccctacatgaagatgatct

SEQ ID NO: 47184 - DNA, 23 bp, Homo sapiens
atccactacttcacgggcctgca

SEQ ID NO: 47185 - DNA, 24 bp, Homo sapiens
tcagccctcagaccagctggtgtg

SEQ ID NO: 47186 - DNA, 24 bp, Homo sapiens
ctcagccctcagaccagctggtgt

SEQ ID NO: 47187 - DNA, 24 bp, Homo sapiens
gctcagccctcagaccagctggtg

SEQ ID NO: 47188 - DNA, 24 bp, Homo sapiens
taaaaaacaaaactcttccagctg

SEQ ID NO: 47189 - DNA, 24 bp, Homo sapiens
ctaaaaaacaaaactcttccagct

SEQ ID NO: 47190 - DNA, 24 bp, Homo sapiens
tctaaaaaacaaaactcttccagc

SEQ ID NO: 47191 - DNA, 24 bp, Homo sapiens
ccggtgggcagtggtctgggctac

SEQ ID NO: 47192 - DNA, 24 bp, Homo sapiens
tccggtgggcagtggtctgggcta

SEQ ID NO: 47193 - DNA, 24 bp, Homo sapiens
ttccggtgggcagtggtctgggct

SEQ ID NO: 47194 - DNA, 23 bp, Homo sapiens
gctctcatagtggcggtgctgtg

SEQ ID NO: 47195 - DNA, 23 bp, Homo sapiens
cttcaccgtggctggcgtccttc

SEQ ID NO: 47196 - DNA, 25 bp, Homo sapiens
ggctcatccagaccgtgttcatctc

SEQ ID NO: 47197 - DNA, 24 bp, Homo sapiens
ctgctgctgctgctgcttctacct

SEQ ID NO: 47198 - DNA, 24 bp, Homo sapiens
tgccaatcatgctgctcctgctac

SEQ ID NO: 47199 - DNA, 24 bp, Homo sapiens
ccaagatacagagatcaggacgcc

SEQ ID NO: 47200 - DNA, 24 bp, Homo sapiens
gcaccccaccccagccactcaact

SEQ ID NO: 47201 - DNA, 24 bp, Homo sapiens
tgcaccccaccccagccactcaac

SEQ ID NO: 47202 - DNA, 24 bp, Homo sapiens
ctgcaccccaccccagccactcaa

SEQ ID NO: 47203 - DNA, 25 bp, Homo sapiens
gactgtagacacaactaggctccgt

SEQ ID NO: 47204 - DNA, 24 bp, Homo sapiens
gacaccttcattgcctctcctcgc

SEQ ID NO: 47205 - DNA, 24 bp, Homo sapiens
agcgtggtggttcatgcctgtaat

SEQ ID NO: 47206 - DNA, 24 bp, Homo sapiens
atttacactgggcttccagctgac

SEQ ID NO: 47207 - DNA, 24 bp, Homo sapiens
catttacactgggcttccagctga

SEQ ID NO: 47208 - DNA, 24 bp, Homo sapiens
gcatttacactgggcttccagctg

SEQ ID NO: 47209 - DNA, 25 bp, Homo sapiens
tggagcaggagacaggtgacatagc

SEQ ID NO: 47210 - DNA, 23 bp, Homo sapiens
ccaagtacgagatgcggagccag

SEQ ID NO: 47211 - DNA, 23 bp, Homo sapiens
aatggctcaaggagggcgtggag

SEQ ID NO: 47212 - DNA, 24 bp, Homo sapiens
tggagtatgcaacatgaaaatgaa

SEQ ID NO: 47213 - DNA, 24 bp, Homo sapiens
ttggagtatgcaacatgaaaatga

SEQ ID NO: 47214 - DNA, 24 bp, Homo sapiens
tttggagtatgcaacatgaaaatg

SEQ ID NO: 47215 - DNA, 24 bp, Homo sapiens
attctaaccaagaacaagaagata

SEQ ID NO: 47216 - DNA, 24 bp, Homo sapiens
gattctaaccaagaacaagaagat

SEQ ID NO: 47217 - DNA, 24 bp, Homo sapiens
agattctaaccaagaacaagaaga

SEQ ID NO: 47218 - DNA, 25 bp, Homo sapiens
aaagttcttcaggaaggtcgggcat

SEQ ID NO: 47219 - DNA, 25 bp, Homo sapiens
gctgaggcaggaagattgcttgagc

SEQ ID NO: 47220 - DNA, 25 bp, Homo sapiens
acaaattagagttttcctactgact

SEQ ID NO: 47221 - DNA, 24 bp, Homo sapiens
gaaaggcattagtaagtaccaaag

SEQ ID NO: 47222 - DNA, 24 bp, Homo sapiens
agaaaggcattagtaagtaccaaa

SEQ ID NO: 47223 - DNA, 24 bp, Homo sapiens
gagaaaggcattagtaagtaccaa

SEQ ID NO: 47224 - DNA, 24 bp, Homo sapiens
ggaagaaatacgccaagcaaataa

SEQ ID NO: 47225 - DNA, 24 bp, Homo sapiens
tggaagaaatacgccaagcaaata

SEQ ID NO: 47226 - DNA, 24 bp, Homo sapiens
gtggaagaaatacgccaagcaaat

SEQ ID NO: 47227 - DNA, 24 bp, Homo sapiens
gtattttgtaggttataagacatc

SEQ ID NO: 47228 - DNA, 24 bp, Homo sapiens
agtattttgtaggttataagacat

SEQ ID NO: 47229 - DNA, 24 bp, Homo sapiens
aagtattttgtaggttataagaca

SEQ ID NO: 47230 - DNA, 24 bp, Homo sapiens
tggattatttggttttcagattac

SEQ ID NO: 47231 - DNA, 24 bp, Homo sapiens
atggattatttggttttcagatta

SEQ ID NO: 47232 - DNA, 24 bp, Homo sapiens
tatggattatttggttttcagatt

SEQ ID NO: 47233 - DNA, 24 bp, Homo sapiens
tgttttttaagattcagaaggttt

SEQ ID NO: 47234 - DNA, 24 bp, Homo sapiens
atgttttttaagattcagaaggtt

SEQ ID NO: 47235 - DNA, 24 bp, Homo sapiens
tatgttttttaagattcagaaggt

SEQ ID NO: 47236 - DNA, 25 bp, Homo sapiens
ggatggccaaggactgttactgtga

SEQ ID NO: 47237 - DNA, 23 bp, Homo sapiens
tatcaaatgacaatgcatttgga

SEQ ID NO: 47238 - DNA, 24 bp, Homo sapiens
ttgatttggctgatttaaatatag

SEQ ID NO: 47239 - DNA, 24 bp, Homo sapiens
attgatttggctgatttaaatata

SEQ ID NO: 47240 - DNA, 24 bp, Homo sapiens
cattgatttggctgatttaaatat

SEQ ID NO: 47241 - DNA, 25 bp, Homo sapiens
accgagtagagccaagagatagcaa

SEQ ID NO: 47242 - DNA, 23 bp, Homo sapiens
ggtcctcagcagccacggagaac

SEQ ID NO: 47243 - DNA, 25 bp, Homo sapiens
agtgccaccattgtcaatataacga

SEQ ID NO: 47244 - DNA, 24 bp, Homo sapiens
ctttgctgaaggagaaattttaca

SEQ ID NO: 47245 - DNA, 24 bp, Homo sapiens
cctttgctgaaggagaaattttac

SEQ ID NO: 47246 - DNA, 24 bp, Homo sapiens
acctttgctgaaggagaaatttta

SEQ ID NO: 47247 - DNA, 25 bp, Homo sapiens
cctggaatgctgagtctgaagaacc

SEQ ID NO: 47248 - DNA, 25 bp, Homo sapiens
aacctagcagagccagaagttgatt

SEQ ID NO: 47249 - DNA, 25 bp, Homo sapiens
acagcagcagccatcaacattacca

SEQ ID NO: 47250 - DNA, 25 bp, Homo sapiens
ccgaggtgtaattgaatggcaacaa

SEQ ID NO: 47251 - DNA, 25 bp, Homo sapiens
ggctgcttcaacttcatttcctccc

SEQ ID NO: 47252 - DNA, 25 bp, Homo sapiens
acagcagcagccatcaacattacca

SEQ ID NO: 47253 - DNA, 24 bp, Homo sapiens
aattattcctggtcttcaggtgga

SEQ ID NO: 47254 - DNA, 24 bp, Homo sapiens
aaattattcctggtcttcaggtgg

SEQ ID NO: 47255 - DNA, 24 bp, Homo sapiens
taaattattcctggtcttcaggtg

SEQ ID NO: 47256 - DNA, 24 bp, Homo sapiens
ggagactcaccactagaagacgat

SEQ ID NO: 47257 - DNA, 24 bp, Homo sapiens
cctctgctgctgctgctgctgctg

SEQ ID NO: 47258 - DNA, 24 bp, Homo sapiens
gtgaagtatggggatgtgtactgc

SEQ ID NO: 47259 - DNA, 24 bp, Homo sapiens
ggagactcaccactagaagacgat

SEQ ID NO: 47260 - DNA, 24 bp, Homo sapiens
cctctgctgctgctgctgctgctg

SEQ ID NO: 47261 - DNA, 24 bp, Homo sapiens
ccttggtctcttcggtctcctgcc

SEQ ID NO: 47262 - DNA, 24 bp, Homo sapiens
agcaaatctgagtaagtccaatgt

SEQ ID NO: 47263 - DNA, 24 bp, Homo sapiens
cagcaaatctgagtaagtccaatg

SEQ ID NO: 47264 - DNA, 24 bp, Homo sapiens
acagcaaatctgagtaagtccaat

SEQ ID NO: 47265 - DNA, 24 bp, Homo sapiens
agaataaaatggtaaatatctctt

SEQ ID NO: 47266 - DNA, 24 bp, Homo sapiens
cagaataaaatggtaaatatctct

SEQ ID NO: 47267 - DNA, 24 bp, Homo sapiens
tcagaataaaatggtaaatatctc

SEQ ID NO: 47268 - DNA, 23 bp, Homo sapiens
actcctgggctcaagcgatctgc

SEQ ID NO: 47269 - DNA, 23 bp, Homo sapiens
gcaactcttaatccattccttgg

SEQ ID NO: 47270 - DNA, 23 bp, Homo sapiens
gagaggatgcgttgatgaggctc

SEQ ID NO: 47271 - DNA, 25 bp, Homo sapiens
cgagatgtgattgacagcctggtgg

SEQ ID NO: 47272 - DNA, 23 bp, Homo sapiens
ccatgtggctgaggtctgtgctg

SEQ ID NO: 47273 - DNA, 24 bp, Homo sapiens
gctttgccagggtacttttacagc

SEQ ID NO: 47274 - DNA, 24 bp, Homo sapiens
agctttgccagggtacttttacag

SEQ ID NO: 47275 - DNA, 24 bp, Homo sapiens
cagctttgccagggtacttttaca

SEQ ID NO: 47276 - DNA, 24 bp, Homo sapiens
tccatggcattgatgtctttattc

SEQ ID NO: 47277 - DNA, 24 bp, Homo sapiens
atccatggcattgatgtctttatt

SEQ ID NO: 47278 - DNA, 24 bp, Homo sapiens
aatccatggcattgatgtctttat

SEQ ID NO: 47279 - DNA, 24 bp, Homo sapiens
ttgtttctaagatctggtataaag

SEQ ID NO: 47280 - DNA, 24 bp, Homo sapiens
tttgtttctaagatctggtataaa

SEQ ID NO: 47281 - DNA, 24 bp, Homo sapiens
ttttgtttctaagatctggtataa

SEQ ID NO: 47282 - DNA, 24 bp, Homo sapiens
cgggcaggcagtatgggcttattt

SEQ ID NO: 47283 - DNA, 23 bp, Homo sapiens
ttcagcggacacgggagcaagat

SEQ ID NO: 47284 - DNA, 24 bp, Homo sapiens
aaaccatcagtgtttgggaatgat

SEQ ID NO: 47285 - DNA, 24 bp, Homo sapiens
tattattatagctttttatgcaga

SEQ ID NO: 47286 - DNA, 24 bp, Homo sapiens
gtattattatagctttttatgcag

SEQ ID NO: 47287 - DNA, 24 bp, Homo sapiens
tgtattattatagctttttatgca

SEQ ID NO: 47288 - DNA, 23 bp, Homo sapiens
gcctacaggttccacttctgccg

SEQ ID NO: 47289 - DNA, 23 bp, Homo sapiens
aacagccagtgccagacacagtc

SEQ ID NO: 47290 - DNA, 25 bp, Homo sapiens
gttcctgagcctggactacattccg

SEQ ID NO: 47291 - DNA, 25 bp, Homo sapiens
gttcctgagcctggactacattccg

SEQ ID NO: 47292 - DNA, 23 bp, Homo sapiens
ttcagacaccaggcagggctcaa

SEQ ID NO: 47293 - DNA, 23 bp, Homo sapiens
gcctacaggttccacttctgccg

SEQ ID NO: 47294 - DNA, 24 bp, Homo sapiens
tttaattttagagacctattacta

SEQ ID NO: 47295 - DNA, 24 bp, Homo sapiens
ttttaattttagagacctattact

SEQ ID NO: 47296 - DNA, 24 bp, Homo sapiens
tttttaattttagagacctattac

SEQ ID NO: 47297 - DNA, 24 bp, Homo sapiens
ctttaaagcaggaataataatggt

SEQ ID NO: 47298 - DNA, 24 bp, Homo sapiens
gctttaaagcaggaataataatgg

SEQ ID NO: 47299 - DNA, 24 bp, Homo sapiens
ggctttaaagcaggaataataatg

SEQ ID NO: 47300 - DNA, 23 bp, Homo sapiens
tgtctgcctgctccttcctctgg

SEQ ID NO: 47301 - DNA, 24 bp, Homo sapiens
agaggtatcatcagtgagagttgc

SEQ ID NO: 47302 - DNA, 23 bp, Homo sapiens
ccctggttgccttgagttttccc

SEQ ID NO: 47303 - DNA, 24 bp, Homo sapiens
caagggcagagatgaagcgccctc

SEQ ID NO: 47304 - DNA, 24 bp, Homo sapiens
ccaagggcagagatgaagcgccct

SEQ ID NO: 47305 - DNA, 24 bp, Homo sapiens
cccaagggcagagatgaagcgccc

SEQ ID NO: 47306 - DNA, 24 bp, Homo sapiens
taaagagtcaagtaagttaaaatc

SEQ ID NO: 47307 - DNA, 24 bp, Homo sapiens
ttaaagagtcaagtaagttaaaat

SEQ ID NO: 47308 - DNA, 24 bp, Homo sapiens
cttaaagagtcaagtaagttaaaa

SEQ ID NO: 47309 - DNA, 24 bp, Homo sapiens
tctagaggaaagagaaaaaaagca

SEQ ID NO: 47310 - DNA, 24 bp, Homo sapiens
atctagaggaaagagaaaaaaagc

SEQ ID NO: 47311 - DNA, 24 bp, Homo sapiens
aatctagaggaaagagaaaaaaag

SEQ ID NO: 47312 - DNA, 24 bp, Homo sapiens
tataacataaggagaaaaaaagca

SEQ ID NO: 47313 - DNA, 24 bp, Homo sapiens
ttataacataaggagaaaaaaagc

SEQ ID NO: 47314 - DNA, 24 bp, Homo sapiens
tttataacataaggagaaaaaaag

SEQ ID NO: 47315 - DNA, 25 bp, Homo sapiens
caccaccttcatccttgtcatcctc

SEQ ID NO: 47316 - DNA, 25 bp, Homo sapiens
catctgctgcttagaagagtggacc

SEQ ID NO: 47317 - DNA, 23 bp, Homo sapiens
taggtgtggtctggctggtggca

SEQ ID NO: 47318 - DNA, 24 bp, Homo sapiens
cattaccttgcctcacggacacca

SEQ ID NO: 47319 - DNA, 24 bp, Homo sapiens
catcggcattgcagtggacattct

SEQ ID NO: 47320 - DNA, 24 bp, Homo sapiens
aggtggcggtggaactgaaggatt

SEQ ID NO: 47321 - DNA, 24 bp, Homo sapiens
attttctgtagatcttaaaagtgc

SEQ ID NO: 47322 - DNA, 24 bp, Homo sapiens
tattttctgtagatcttaaaagtg

SEQ ID NO: 47323 - DNA, 24 bp, Homo sapiens
ttattttctgtagatcttaaaagt

SEQ ID NO: 47324 - DNA, 24 bp, Homo sapiens
actggaaaaggagatgtatttacc

SEQ ID NO: 47325 - DNA, 24 bp, Homo sapiens
aactggaaaaggagatgtatttac

SEQ ID NO: 47326 - DNA, 24 bp, Homo sapiens
taactggaaaaggagatgtattta

SEQ ID NO: 47327 - DNA, 24 bp, Homo sapiens
acaacatcaaggaggaatttttat

SEQ ID NO: 47328 - DNA, 24 bp, Homo sapiens
aacaacatcaaggaggaattttta

SEQ ID NO: 47329 - DNA, 24 bp, Homo sapiens
aaacaacatcaaggaggaattttt

SEQ ID NO: 47330 - DNA, 23 bp, Homo sapiens
aacctcgggattcagcgggcaag

SEQ ID NO: 47331 - DNA, 23 bp, Homo sapiens
gtaggctgtgtgcggttggctgg

SEQ ID NO: 47332 - DNA, 25 bp, Homo sapiens
ccaatcctgaaggacttcggcactc

SEQ ID NO: 47333 - DNA, 24 bp, Homo sapiens
gcctacctaaaccagcacttgtct

SEQ ID NO: 47334 - DNA, 23 bp, Homo sapiens
aggtgctactggcgagtccgatt

SEQ ID NO: 47335 - DNA, 23 bp, Homo sapiens
gtaggctgtgtgcggttggctgg

SEQ ID NO: 47336 - DNA, 24 bp, Homo sapiens
tttccttctagtttcagaaaatta

SEQ ID NO: 47337 - DNA, 24 bp, Homo sapiens
ttttccttctagtttcagaaaatt

SEQ ID NO: 47338 - DNA, 24 bp, Homo sapiens
tttttccttctagtttcagaaaat

SEQ ID NO: 47339 - DNA, 24 bp, Homo sapiens
acatgataaaggtaacagtcctta

SEQ ID NO: 47340 - DNA, 24 bp, Homo sapiens
cacatgataaaggtaacagtcctt

SEQ ID NO: 47341 - DNA, 24 bp, Homo sapiens
tcacatgataaaggtaacagtcct

SEQ ID NO: 47342 - DNA, 24 bp, Homo sapiens
atcattttcagagcctgatttagg

SEQ ID NO: 47343 - DNA, 24 bp, Homo sapiens
catcattttcagagcctgatttag

SEQ ID NO: 47344 - DNA, 24 bp, Homo sapiens
acatcattttcagagcctgattta

SEQ ID NO: 47345 - DNA, 23 bp, Homo sapiens
gccacgttgattcagccaagcac

SEQ ID NO: 47346 - DNA, 23 bp, Homo sapiens
ccctcagccacagcccagagcac

SEQ ID NO: 47347 - DNA, 23 bp, Homo sapiens
aggtcccctctggatgtcccatg

SEQ ID NO: 47348 - DNA, 24 bp, Homo sapiens
ttattttgcagagtatatgcaaaa

SEQ ID NO: 47349 - DNA, 24 bp, Homo sapiens
tttattttgcagagtatatgcaaa

SEQ ID NO: 47350 - DNA, 24 bp, Homo sapiens
ctttattttgcagagtatatgcaa

SEQ ID NO: 47351 - DNA, 25 bp, Homo sapiens
ggtcacagccaacagccctataaca

SEQ ID NO: 47352 - DNA, 25 bp, Homo sapiens
atcaaagtttaacacgacataggcg

SEQ ID NO: 47353 - DNA, 25 bp, Homo sapiens
tcagtattcgtaaggaaaggtgtga

SEQ ID NO: 47354 - DNA, 25 bp, Homo sapiens
atctcaagtaatcaactcgcctcgg

SEQ ID NO: 47355 - DNA, 24 bp, Homo sapiens
aagtgctgggattacaggtgtgag

SEQ ID NO: 47356 - DNA, 23 bp, Homo sapiens
ttgttggccaggctggtctcaaa

SEQ ID NO: 47357 - DNA, 24 bp, Homo sapiens
ccacatgacatccgaggatctgag

SEQ ID NO: 47358 - DNA, 24 bp, Homo sapiens
gtgtttggctgaacctgggagacc

SEQ ID NO: 47359 - DNA, 24 bp, Homo sapiens
gcttcttgttgaggctggaactgt

SEQ ID NO: 47360 - DNA, 24 bp, Homo sapiens
accaatggaagattccactccgct

SEQ ID NO: 47361 - DNA, 24 bp, Homo sapiens
taccaatggaagattccactccgc

SEQ ID NO: 47362 - DNA, 24 bp, Homo sapiens
ttaccaatggaagattccactccg

SEQ ID NO: 47363 - DNA, 24 bp, Homo sapiens
ctgcacatcagcctgcagcacaaa

SEQ ID NO: 47364 - DNA, 24 bp, Homo sapiens
gctgcacatcagcctgcagcacaa

SEQ ID NO: 47365 - DNA, 24 bp, Homo sapiens
agctgcacatcagcctgcagcaca

SEQ ID NO: 47366 - DNA, 24 bp, Homo sapiens
ggtggtgctgaacattgtggaggt

SEQ ID NO: 47367 - DNA, 24 bp, Homo sapiens
tgacctgagcagcaacagcatctg

SEQ ID NO: 47368 - DNA, 23 bp, Homo sapiens
cctaccgtcaggatgcttcaggc

SEQ ID NO: 47369 - DNA, 23 bp, Homo sapiens
aatcttcagagccgaggcgtcca

SEQ ID NO: 47370 - DNA, 24 bp, Homo sapiens
catccagcaggacagcacttccag

SEQ ID NO: 47371 - DNA, 24 bp, Homo sapiens
gtctgacagcatctgagccaaccg

SEQ ID NO: 47372 - DNA, 24 bp, Homo sapiens
atatcttccagggaattcataccc

SEQ ID NO: 47373 - DNA, 24 bp, Homo sapiens
tatatcttccagggaattcatacc

SEQ ID NO: 47374 - DNA, 24 bp, Homo sapiens
ttatatcttccagggaattcatac

SEQ ID NO: 47375 - DNA, 25 bp, Homo sapiens
gatagtaactgtccctactgaaggc

SEQ ID NO: 47376 - DNA, 23 bp, Homo sapiens
aatgtagttctcggggccagggg

SEQ ID NO: 47377 - DNA, 23 bp, Homo sapiens
gcgcatgagcagatgaggcctag

SEQ ID NO: 47378 - DNA, 24 bp, Homo sapiens
aagtcctgaagaaataaatatctt

SEQ ID NO: 47379 - DNA, 24 bp, Homo sapiens
aaagtcctgaagaaataaatatct

SEQ ID NO: 47380 - DNA, 24 bp, Homo sapiens
aaaagtcctgaagaaataaatatc

SEQ ID NO: 47381 - DNA, 25 bp, Homo sapiens
gctctacttgcctggtggtaattcc

SEQ ID NO: 47382 - DNA, 23 bp, Homo sapiens
gcagcacagacacggacaggatg

SEQ ID NO: 47383 - DNA, 23 bp, Homo sapiens
gtcctcaccgtcaagcagctcca

SEQ ID NO: 47384 - DNA, 23 bp, Homo sapiens
ttgtctgcggcttgtcctgctac

SEQ ID NO: 47385 - DNA, 23 bp, Homo sapiens
ccgtggaggatcaatgtggtggc

SEQ ID NO: 47386 - DNA, 24 bp, Homo sapiens
caggaaggaattggcacttggagt

SEQ ID NO: 47387 - DNA, 23 bp, Homo sapiens
agaggtcatcctgtcgccagtcc

SEQ ID NO: 47388 - DNA, 24 bp, Homo sapiens
cgaggatgtggaggatgagttgat

SEQ ID NO: 47389 - DNA, 23 bp, Homo sapiens
gccgtctgacaaggtggatggtg

SEQ ID NO: 47390 - DNA, 23 bp, Homo sapiens
ccctgcctaccctccttcttgcc

SEQ ID NO: 47391 - DNA, 23 bp, Homo sapiens
cgtctcccgtccgcccctcactc

SEQ ID NO: 47392 - DNA, 23 bp, Homo sapiens
gctgtggaactagcgcgtgcccc

SEQ ID NO: 47393 - DNA, 24 bp, Homo sapiens
gattctttagaggatggattgata

SEQ ID NO: 47394 - DNA, 24 bp, Homo sapiens
tgattctttagaggatggattgat

SEQ ID NO: 47395 - DNA, 24 bp, Homo sapiens
ttgattctttagaggatggattga

SEQ ID NO: 47396 - DNA, 25 bp, Homo sapiens
aatgtgaacttctgccgtgagtccg

SEQ ID NO: 47397 - DNA, 23 bp, Homo sapiens
cgactgtgagaagttgcggcgtc

SEQ ID NO: 47398 - DNA, 23 bp, Homo sapiens
aaatggtgctggctttgctggag

SEQ ID NO: 47399 - DNA, 24 bp, Homo sapiens
tacacaagatggtaaagtgaatgt

SEQ ID NO: 47400 - DNA, 24 bp, Homo sapiens
atacacaagatggtaaagtgaatg

SEQ ID NO: 47401 - DNA, 24 bp, Homo sapiens
gatacacaagatggtaaagtgaat

SEQ ID NO: 47402 - DNA, 24 bp, Homo sapiens
agcattgagccacatatcaatata

SEQ ID NO: 47403 - DNA, 24 bp, Homo sapiens
cagcattgagccacatatcaatat

SEQ ID NO: 47404 - DNA, 24 bp, Homo sapiens
tcagcattgagccacatatcaata

SEQ ID NO: 47405 - DNA, 25 bp, Homo sapiens
tgtgattacaacggactggatcagc

SEQ ID NO: 47406 - DNA, 25 bp, Homo sapiens
tgcccagtgatgaagtttccagagc

SEQ ID NO: 47407 - DNA, 25 bp, Homo sapiens
gttgatgtaaatctccctggtttgc

SEQ ID NO: 47408 - DNA, 23 bp, Homo sapiens
gcttgtgcctgcttacctgctgt

SEQ ID NO: 47409 - DNA, 25 bp, Homo sapiens
acaattcagaggaagaacggcagca

SEQ ID NO: 47410 - DNA, 25 bp, Homo sapiens
gcagcagcggcagaagtatttgatt

SEQ ID NO: 47411 - DNA, 24 bp, Homo sapiens
gtctgcgacaggtgccaccgctgc

SEQ ID NO: 47412 - DNA, 24 bp, Homo sapiens
ggtctgcgacaggtgccaccgctg

SEQ ID NO: 47413 - DNA, 24 bp, Homo sapiens
gggtctgcgacaggtgccaccgct

SEQ ID NO: 47414 - DNA, 24 bp, Homo sapiens
ttatgtttcagggttcttctaata

SEQ ID NO: 47415 - DNA, 24 bp, Homo sapiens
tttatgtttcagggttcttctaat

SEQ ID NO: 47416 - DNA, 24 bp, Homo sapiens
atttatgtttcagggttcttctaa

SEQ ID NO: 47417 - DNA, 24 bp, Homo sapiens
cttgctaaaaagtaagtacaaacc

SEQ ID NO: 47418 - DNA, 24 bp, Homo sapiens
tcttgctaaaaagtaagtacaaac

SEQ ID NO: 47419 - DNA, 24 bp, Homo sapiens
atcttgctaaaaagtaagtacaaa

SEQ ID NO: 47420 - DNA, 23 bp, Homo sapiens
gagagcgagagcctgcctcaacc

SEQ ID NO: 47421 - DNA, 25 bp, Homo sapiens
agaaggataaccgagatggtcgcca

SEQ ID NO: 47422 - DNA, 23 bp, Homo sapiens
cggcatttaggctcggtctccac

SEQ ID NO: 47423 - DNA, 23 bp, Homo sapiens
gcagaagactggaggaggcggag

SEQ ID NO: 47424 - DNA, 23 bp, Homo sapiens
gagagcgagagcctgcctcaacc

SEQ ID NO: 47425 - DNA, 25 bp, Homo sapiens
agaaggataaccgagatggtcgcca

SEQ ID NO: 47426 - DNA, 24 bp, Homo sapiens
acctggaactgcctgacttatgcc

SEQ ID NO: 47427 - DNA, 25 bp, Homo sapiens
cttggcttggctcttgacttggaca

SEQ ID NO: 47428 - DNA, 25 bp, Homo sapiens
ccaagaagaggaagaagaccaaggc

SEQ ID NO: 47429 - DNA, 25 bp, Homo sapiens
ttatgccagccctacagaagtgact

SEQ ID NO: 47430 - DNA, 24 bp, Homo sapiens
cattgcaggaacaacaccttggct

SEQ ID NO: 47431 - DNA, 25 bp, Homo sapiens
gtcttgcaggactcactggatagat

SEQ ID NO: 47432 - DNA, 24 bp, Homo sapiens
catgaacatcagtaagaattataa

SEQ ID NO: 47433 - DNA, 24 bp, Homo sapiens
acatgaacatcagtaagaattata

SEQ ID NO: 47434 - DNA, 24 bp, Homo sapiens
aacatgaacatcagtaagaattat

SEQ ID NO: 47435 - DNA, 25 bp, Homo sapiens
aagtaattggtggtggtgctggagg

SEQ ID NO: 47436 - DNA, 25 bp, Homo sapiens
caggaagatgatgaaataggaagca

SEQ ID NO: 47437 - DNA, 24 bp, Homo sapiens
tctgtttcctcatctagacaacaa

SEQ ID NO: 47438 - DNA, 24 bp, Homo sapiens
tgcttccccaggtgcaaactctac

SEQ ID NO: 47439 - DNA, 24 bp, Homo sapiens
ctgcttccccaggtgcaaactcta

SEQ ID NO: 47440 - DNA, 24 bp, Homo sapiens
tctgcttccccaggtgcaaactct

SEQ ID NO: 47441 - DNA, 24 bp, Homo sapiens
agaccatcaaggtgcaaactctac

SEQ ID NO: 47442 - DNA, 24 bp, Homo sapiens
aagaccatcaaggtgcaaactcta

SEQ ID NO: 47443 - DNA, 24 bp, Homo sapiens
caagaccatcaaggtgcaaactct

SEQ ID NO: 47444 - DNA, 24 bp, Homo sapiens
ttatttcctaggtgatttggattg

SEQ ID NO: 47445 - DNA, 24 bp, Homo sapiens
tttatttcctaggtgatttggatt

SEQ ID NO: 47446 - DNA, 24 bp, Homo sapiens
atttatttcctaggtgatttggat

SEQ ID NO: 47447 - DNA, 24 bp, Homo sapiens
cagaaaattggttctttggaagac

SEQ ID NO: 47448 - DNA, 24 bp, Homo sapiens
ccagaaaattggttctttggaaga

SEQ ID NO: 47449 - DNA, 24 bp, Homo sapiens
tccagaaaattggttctttggaag

SEQ ID NO: 47450 - DNA, 24 bp, Homo sapiens
agtagataccacttcacctctgct

SEQ ID NO: 47451 - DNA, 24 bp, Homo sapiens
aatgcccatctcaatgcctctgcc

SEQ ID NO: 47452 - DNA, 24 bp, Homo sapiens
ttgctgctgttgccactgctggta

SEQ ID NO: 47453 - DNA, 24 bp, Homo sapiens
atgagccactgtgcctgaccttac

SEQ ID NO: 47454 - DNA, 25 bp, Homo sapiens
tcaaaattaatgcaaaaatccatga

SEQ ID NO: 47455 - DNA, 24 bp, Homo sapiens
cttccaacccaacactgctggctc

SEQ ID NO: 47456 - DNA, 24 bp, Homo sapiens
gaagccccccaccctgcacctacg

SEQ ID NO: 47457 - DNA, 24 bp, Homo sapiens
agaacacagaaggcagcttccagt

SEQ ID NO: 47458 - DNA, 24 bp, Homo sapiens
ctgcccattctgcggaacatcact

SEQ ID NO: 47459 - DNA, 24 bp, Homo sapiens
ctccgacctccgctacaacaccag

SEQ ID NO: 47460 - DNA, 24 bp, Homo sapiens
gtgtcactcagccagcctcgtacc

SEQ ID NO: 47461 - DNA, 24 bp, Homo sapiens
agaacacagaaggcagcttccagt

SEQ ID NO: 47462 - DNA, 24 bp, Homo sapiens
gaagccccccaccctgcacctacg

SEQ ID NO: 47463 - DNA, 24 bp, Homo sapiens
ccccatgggcttccaacccaacac

SEQ ID NO: 47464 - DNA, 24 bp, Homo sapiens
atttattttagtaattaatggtga

SEQ ID NO: 47465 - DNA, 24 bp, Homo sapiens
gatttattttagtaattaatggtg

SEQ ID NO: 47466 - DNA, 24 bp, Homo sapiens
tgatttattttagtaattaatggt

SEQ ID NO: 47467 - DNA, 24 bp, Homo sapiens
gaaaacaaaaggtgacttgataga

SEQ ID NO: 47468 - DNA, 24 bp, Homo sapiens
agaaaacaaaaggtgacttgatag

SEQ ID NO: 47469 - DNA, 24 bp, Homo sapiens
gagaaaacaaaaggtgacttgata

SEQ ID NO: 47470 - DNA, 24 bp, Homo sapiens
atgccttccctacagtcccacaaa

SEQ ID NO: 47471 - DNA, 25 bp, Homo sapiens
tcttgtccgtgaccctttctgacca

SEQ ID NO: 47472 - DNA, 24 bp, Homo sapiens
ttggaaacgatgccgagaagagcc

SEQ ID NO: 47473 - DNA, 23 bp, Homo sapiens
aactgatcgaggtcctggatgac

SEQ ID NO: 47474 - DNA, 23 bp, Homo sapiens
ggagattgccatcctgaagaagc

SEQ ID NO: 47475 - DNA, 23 bp, Homo sapiens
ccagggaggaccagccaagcagc

SEQ ID NO: 47476 - DNA, 25 bp, Homo sapiens
atcggtggtgatgatgatgacctcc

SEQ ID NO: 47477 - DNA, 23 bp, Homo sapiens
gcagttggatttccgaaggcgac

SEQ ID NO: 47478 - DNA, 23 bp, Homo sapiens
cgggtcttcttggtgcctgaggg

SEQ ID NO: 47479 - DNA, 25 bp, Homo sapiens
aagatcacaccattgcactccagcc

SEQ ID NO: 47480 - DNA, 24 bp, Homo sapiens
tgtagtcccagctacctgtggcag

SEQ ID NO: 47481 - DNA, 25 bp, Homo sapiens
aaattgtattgattttctcttttca

SEQ ID NO: 47482 - DNA, 23 bp, Homo sapiens
gtggagtggaggaaggtaaccgc

SEQ ID NO: 47483 - DNA, 25 bp, Homo sapiens
ggaccctggactttcactttgagac

SEQ ID NO: 47484 - DNA, 23 bp, Homo sapiens
aaggaggaatccctcggacagcc

SEQ ID NO: 47485 - DNA, 24 bp, Homo sapiens
ccaatcttgtgtgggcactgaagg

SEQ ID NO: 47486 - DNA, 23 bp, Homo sapiens
ggctgaggaggaagtggaggtgt

SEQ ID NO: 47487 - DNA, 23 bp, Homo sapiens
gcttcctccacagccacctccgg

SEQ ID NO: 47488 - DNA, 24 bp, Homo sapiens
gtggatgtgagagagattggaaca

SEQ ID NO: 47489 - DNA, 24 bp, Homo sapiens
agtggatgtgagagagattggaac

SEQ ID NO: 47490 - DNA, 24 bp, Homo sapiens
cagtggatgtgagagagattggaa

SEQ ID NO: 47491 - DNA, 23 bp, Homo sapiens
actttgcctgcgtggaccttacc

SEQ ID NO: 47492 - DNA, 25 bp, Homo sapiens
tctgagttcactgacaccatcctgt

SEQ ID NO: 47493 - DNA, 24 bp, Homo sapiens
cgaggcaggaggacatcagaggaa

SEQ ID NO: 47494 - DNA, 24 bp, Homo sapiens
caacaggaggaaaatgtctttcct

SEQ ID NO: 47495 - DNA, 24 bp, Homo sapiens
ccaacaggaggaaaatgtctttcc

SEQ ID NO: 47496 - DNA, 24 bp, Homo sapiens
tccaacaggaggaaaatgtctttc

SEQ ID NO: 47497 - DNA, 25 bp, Homo sapiens
agaaccagacacagatgagcagagg

SEQ ID NO: 47498 - DNA, 25 bp, Homo sapiens
ggctcacagcacttgatccgataca

SEQ ID NO: 47499 - DNA, 23 bp, Homo sapiens
cagtgagccgaggtcgtgccatt

SEQ ID NO: 47500 - DNA, 25 bp, Homo sapiens
ggctcacagcacttgatccgataca

SEQ ID NO: 47501 - DNA, 23 bp, Homo sapiens
aacagccaggcatggtgactcag

SEQ ID NO: 47502 - DNA, 23 bp, Homo sapiens
cagtgagccgaggtcgtgccatt

SEQ ID NO: 47503 - DNA, 24 bp, Homo sapiens
tctctgtttagaaacctgctctac

SEQ ID NO: 47504 - DNA, 24 bp, Homo sapiens
ttctctgtttagaaacctgctcta

SEQ ID NO: 47505 - DNA, 24 bp, Homo sapiens
tttctctgtttagaaacctgctct

SEQ ID NO: 47506 - DNA, 25 bp, Homo sapiens
cggagagagcaagaaaggattcgtc

SEQ ID NO: 47507 - DNA, 23 bp, Homo sapiens
tagagtcctggtggagcagcagc

SEQ ID NO: 47508 - DNA, 23 bp, Homo sapiens
gctctgctcagtggagaccttga

SEQ ID NO: 47509 - DNA, 24 bp, Homo sapiens
cagggcagcaggtcccagctagtc

SEQ ID NO: 47510 - DNA, 24 bp, Homo sapiens
ccagggcagcaggtcccagctagt

SEQ ID NO: 47511 - DNA, 24 bp, Homo sapiens
cccagggcagcaggtcccagctag

SEQ ID NO: 47512 - DNA, 24 bp, Homo sapiens
tctcaggagtctccatgttcaaca

SEQ ID NO: 47513 - DNA, 23 bp, Homo sapiens
cctctttgcagtggagctggccg

SEQ ID NO: 47514 - DNA, 23 bp, Homo sapiens
gctggtggccgcgctctctgtca

SEQ ID NO: 47515 - DNA, 25 bp, Homo sapiens
ggcattatcttggctcactgtaacc

SEQ ID NO: 47516 - DNA, 23 bp, Homo sapiens
cgccaaagttctgcccagtccaa

SEQ ID NO: 47517 - DNA, 23 bp, Homo sapiens
tctgggctgaagcgatcctcctc

SEQ ID NO: 47518 - DNA, 24 bp, Homo sapiens
aatatattaaggcaacagttaatg

SEQ ID NO: 47519 - DNA, 24 bp, Homo sapiens
gaatatattaaggcaacagttaat

SEQ ID NO: 47520 - DNA, 24 bp, Homo sapiens
tgaatatattaaggcaacagttaa

SEQ ID NO: 47521 - DNA, 24 bp, Homo sapiens
atattctttagctgaagaggaggc

SEQ ID NO: 47522 - DNA, 24 bp, Homo sapiens
aatattctttagctgaagaggagg

SEQ ID NO: 47523 - DNA, 24 bp, Homo sapiens
taatattctttagctgaagaggag

SEQ ID NO: 47524 - DNA, 24 bp, Homo sapiens
ccgccggagccgcagaaacaagag

SEQ ID NO: 47525 - DNA, 24 bp, Homo sapiens
gaactcgcactgcccagagggtgg

SEQ ID NO: 47526 - DNA, 24 bp, Homo sapiens
gcgtgaagaaggtgccacagagat

SEQ ID NO: 47527 - DNA, 24 bp, Homo sapiens
gcctttcgcctcccaccatgattc

SEQ ID NO: 47528 - DNA, 24 bp, Homo sapiens
agtattgtatctggcaacctcccg

SEQ ID NO: 47529 - DNA, 23 bp, Homo sapiens
gttgcctccacgacatcgcactg

SEQ ID NO: 47530 - DNA, 23 bp, Homo sapiens
caccacagccacccagtcccaca

SEQ ID NO: 47531 - DNA, 24 bp, Homo sapiens
aggacaacgaggaggacgaggatg

SEQ ID NO: 47532 - DNA, 24 bp, Homo sapiens
gcttgtcttggagtctcttgtgcc

SEQ ID NO: 47533 - DNA, 24 bp, Homo sapiens
aacagtggcttccttgtattggcg

SEQ ID NO: 47534 - DNA, 24 bp, Homo sapiens
aaacggagtcttgctctgttgccc

SEQ ID NO: 47535 - DNA, 24 bp, Homo sapiens
ctgttatacaggtgcttgttgccc

SEQ ID NO: 47536 - DNA, 24 bp, Homo sapiens
tctgttatacaggtgcttgttgcc

SEQ ID NO: 47537 - DNA, 24 bp, Homo sapiens
ttctgttatacaggtgcttgttgc

SEQ ID NO: 47538 - DNA, 24 bp, Homo sapiens
actctggacaaactgttctgtgtg

SEQ ID NO: 47539 - DNA, 24 bp, Homo sapiens
gactctggacaaactgttctgtgt

SEQ ID NO: 47540 - DNA, 24 bp, Homo sapiens
tgactctggacaaactgttctgtg

SEQ ID NO: 47541 - DNA, 23 bp, Homo sapiens
ttggatggctggatgtggtggct

SEQ ID NO: 47542 - DNA, 25 bp, Homo sapiens
ccattgacgggaaggtgacaaggaa

SEQ ID NO: 47543 - DNA, 23 bp, Homo sapiens
aacccaggagttcgagagcagcc

SEQ ID NO: 47544 - DNA, 24 bp, Homo sapiens
cttatctgaagatgaagttggtat

SEQ ID NO: 47545 - DNA, 24 bp, Homo sapiens
tcttatctgaagatgaagttggta

SEQ ID NO: 47546 - DNA, 24 bp, Homo sapiens
ttcttatctgaagatgaagttggt

SEQ ID NO: 47547 - DNA, 24 bp, Homo sapiens
ttaccagaccggttctcttacatc

SEQ ID NO: 47548 - DNA, 24 bp, Homo sapiens
tttaccagaccggttctcttacat

SEQ ID NO: 47549 - DNA, 24 bp, Homo sapiens
atttaccagaccggttctcttaca

SEQ ID NO: 47550 - DNA, 24 bp, Homo sapiens
acaaagagatggtagactatagca

SEQ ID NO: 47551 - DNA, 24 bp, Homo sapiens
tacaaagagatggtagactatagc

SEQ ID NO: 47552 - DNA, 24 bp, Homo sapiens
gtacaaagagatggtagactatag

SEQ ID NO: 47553 - DNA, 24 bp, Homo sapiens
gatgagggcaggctgctgctggag

SEQ ID NO: 47554 - DNA, 24 bp, Homo sapiens
tgatgagggcaggctgctgctgga

SEQ ID NO: 47555 - DNA, 24 bp, Homo sapiens
ttgatgagggcaggctgctgctgg

SEQ ID NO: 47556 - DNA, 24 bp, Homo sapiens
gctacctctacttcctcttctgcc

SEQ ID NO: 47557 - DNA, 24 bp, Homo sapiens
cctcccgttgtgtcctggtcttcg

SEQ ID NO: 47558 - DNA, 24 bp, Homo sapiens
ggctgctgctggagtttgacctac

SEQ ID NO: 47559 - DNA, 24 bp, Homo sapiens
aacatggatacaactctggaggca

SEQ ID NO: 47560 - DNA, 24 bp, Homo sapiens
cacgaggagttccagcagcaggag

SEQ ID NO: 47561 - DNA, 24 bp, Homo sapiens
cggaaggaggagcaagagccaggg

SEQ ID NO: 47562 - DNA, 24 bp, Homo sapiens
gaaggtacgcctgattgaggaccg

SEQ ID NO: 47563 - DNA, 24 bp, Homo sapiens
ccagtgctaccagcctctcatgga

SEQ ID NO: 47564 - DNA, 24 bp, Homo sapiens
ctgccgccaggaccttgccaccaa

SEQ ID NO: 47565 - DNA, 24 bp, Homo sapiens
cgacccccgagggacctggctccc

SEQ ID NO: 47566 - DNA, 24 bp, Homo sapiens
ccgacccccgagggacctggctcc

SEQ ID NO: 47567 - DNA, 24 bp, Homo sapiens
gccgacccccgagggacctggctc

SEQ ID NO: 47568 - DNA, 24 bp, Homo sapiens
tctttaaacagataagcaatttaa

SEQ ID NO: 47569 - DNA, 24 bp, Homo sapiens
ctctttaaacagataagcaattta

SEQ ID NO: 47570 - DNA, 24 bp, Homo sapiens
tctctttaaacagataagcaattt

SEQ ID NO: 47571 - DNA, 24 bp, Homo sapiens
aagcagaagatagagaagctgcat

SEQ ID NO: 47572 - DNA, 24 bp, Homo sapiens
aaagcagaagatagagaagctgca

SEQ ID NO: 47573 - DNA, 24 bp, Homo sapiens
aaaagcagaagatagagaagctgc

SEQ ID NO: 47574 - DNA, 25 bp, Homo sapiens
aacagaatcaaggagcagcaccaga

SEQ ID NO: 47575 - DNA, 25 bp, Homo sapiens
aacgagaccgactgttccactcatt

SEQ ID NO: 47576 - DNA, 25 bp, Homo sapiens
tgaagatagactggcaagcacaggc

SEQ ID NO: 47577 - DNA, 24 bp, Homo sapiens
gataataatgtctatttttattcc

SEQ ID NO: 47578 - DNA, 24 bp, Homo sapiens
ggataataatgtctatttttattc

SEQ ID NO: 47579 - DNA, 24 bp, Homo sapiens
gggataataatgtctatttttatt

SEQ ID NO: 47580 - DNA, 24 bp, Homo sapiens
atccacaaagaattccaccttgaa

SEQ ID NO: 47581 - DNA, 24 bp, Homo sapiens
aatccacaaagaattccaccttga

SEQ ID NO: 47582 - DNA, 24 bp, Homo sapiens
aaatccacaaagaattccaccttg

SEQ ID NO: 47583 - DNA, 23 bp, Homo sapiens
cggttctccctcgcagcacctcg

SEQ ID NO: 47584 - DNA, 23 bp, Homo sapiens
cctgctgtcctggccctgaccgg

SEQ ID NO: 47585 - DNA, 23 bp, Homo sapiens
cctgcccgctcgcacccctctcc

SEQ ID NO: 47586 - DNA, 24 bp, Homo sapiens
accgatgtgatatttttactaatg

SEQ ID NO: 47587 - DNA, 24 bp, Homo sapiens
aaccgatgtgatatttttactaat

SEQ ID NO: 47588 - DNA, 24 bp, Homo sapiens
aaaccgatgtgatatttttactaa

SEQ ID NO: 47589 - DNA, 24 bp, Homo sapiens
tcattaaacagctttccaaggaat

SEQ ID NO: 47590 - DNA, 24 bp, Homo sapiens
gtcattaaacagctttccaaggaa

SEQ ID NO: 47591 - DNA, 24 bp, Homo sapiens
tgtcattaaacagctttccaagga

SEQ ID NO: 47592 - DNA, 23 bp, Homo sapiens
tagacggcacccaccacaccctg

SEQ ID NO: 47593 - DNA, 23 bp, Homo sapiens
ccttcagttcgtcagcaggtccg

SEQ ID NO: 47594 - DNA, 24 bp, Homo sapiens
taagcggatgaacagcaacgagcg

SEQ ID NO: 47595 - DNA, 23 bp, Homo sapiens
ggacacagaccagccaccgtacc

SEQ ID NO: 47596 - DNA, 24 bp, Homo sapiens
ccgccaggaacatctacaagcagg

SEQ ID NO: 47597 - DNA, 23 bp, Homo sapiens
cctgaccttcactgtgttcgccg

SEQ ID NO: 47598 - DNA, 24 bp, Homo sapiens
aaacagatgcaaaaatgatgaaga

SEQ ID NO: 47599 - DNA, 24 bp, Homo sapiens
gaaacagatgcaaaaatgatgaag

SEQ ID NO: 47600 - DNA, 24 bp, Homo sapiens
agaaacagatgcaaaaatgatgaa

SEQ ID NO: 47601 - DNA, 24 bp, Homo sapiens
aatgaggaagacgtgagtgaagcc

SEQ ID NO: 47602 - DNA, 24 bp, Homo sapiens
ctgagaacaagctcctggctggtg

SEQ ID NO: 47603 - DNA, 24 bp, Homo sapiens
ttggcttcgtggctggcagtgaga

SEQ ID NO: 47604 - DNA, 24 bp, Homo sapiens
ggtggcgctgggttgcctgcgagg

SEQ ID NO: 47605 - DNA, 24 bp, Homo sapiens
aggtggcgctgggttgcctgcgag

SEQ ID NO: 47606 - DNA, 24 bp, Homo sapiens
caggtggcgctgggttgcctgcga

SEQ ID NO: 47607 - DNA, 24 bp, Homo sapiens
ggacagtctggacgagaatgaggc

SEQ ID NO: 47608 - DNA, 24 bp, Homo sapiens
ggtcctcctccagcaagagcacag

SEQ ID NO: 47609 - DNA, 24 bp, Homo sapiens
catacgaggagcggcagcggcact

SEQ ID NO: 47610 - DNA, 24 bp, Homo sapiens
tgaggagaccaagtgggaggtgtg

SEQ ID NO: 47611 - DNA, 24 bp, Homo sapiens
aagagtctcaggcagagctggtgc

SEQ ID NO: 47612 - DNA, 24 bp, Homo sapiens
ggagctggagctggaagcctgttc

SEQ ID NO: 47613 - DNA, 24 bp, Homo sapiens
ggtccccacagctcttatgttcct

SEQ ID NO: 47614 - DNA, 24 bp, Homo sapiens
gggtccccacagctcttatgttcc

SEQ ID NO: 47615 - DNA, 24 bp, Homo sapiens
ggggtccccacagctcttatgttc

SEQ ID NO: 47616 - DNA, 24 bp, Homo sapiens
gatgagtgcagtgtcgcagcccca

SEQ ID NO: 47617 - DNA, 24 bp, Homo sapiens
agatgagtgcagtgtcgcagcccc

SEQ ID NO: 47618 - DNA, 24 bp, Homo sapiens
gagatgagtgcagtgtcgcagccc

SEQ ID NO: 47619 - DNA, 24 bp, Homo sapiens
cggacgagactggagagacacttg

SEQ ID NO: 47620 - DNA, 25 bp, Homo sapiens
caggaagtgtttgggatgagcatcg

SEQ ID NO: 47621 - DNA, 24 bp, Homo sapiens
ccttgctctggcttctctgtgtcc

SEQ ID NO: 47622 - DNA, 24 bp, Homo sapiens
agttgacagaggcatgtccatttg

SEQ ID NO: 47623 - DNA, 24 bp, Homo sapiens
gagttgacagaggcatgtccattt

SEQ ID NO: 47624 - DNA, 24 bp, Homo sapiens
ggagttgacagaggcatgtccatt

SEQ ID NO: 47625 - DNA, 24 bp, Homo sapiens
gtccagctgcgaatggcgatcagt

SEQ ID NO: 47626 - DNA, 24 bp, Homo sapiens
tgtccagctgcgaatggcgatcag

SEQ ID NO: 47627 - DNA, 24 bp, Homo sapiens
ctgtccagctgcgaatggcgatca

SEQ ID NO: 47628 - DNA, 24 bp, Homo sapiens
ttctttcttaggttatccaaatgt

SEQ ID NO: 47629 - DNA, 24 bp, Homo sapiens
tttctttcttaggttatccaaatg

SEQ ID NO: 47630 - DNA, 24 bp, Homo sapiens
ttttctttcttaggttatccaaat

SEQ ID NO: 47631 - DNA, 24 bp, Homo sapiens
atcaaagataagagaacaaacaag

SEQ ID NO: 47632 - DNA, 24 bp, Homo sapiens
catcaaagataagagaacaaacaa

SEQ ID NO: 47633 - DNA, 24 bp, Homo sapiens
acatcaaagataagagaacaaaca

SEQ ID NO: 47634 - DNA, 23 bp, Homo sapiens
gagggagctggagctgtcacagt

SEQ ID NO: 47635 - DNA, 23 bp, Homo sapiens
gaccgagccaagtggggtgtcat

SEQ ID NO: 47636 - DNA, 23 bp, Homo sapiens
gggcagcggctgcacttcctcag

SEQ ID NO: 47637 - DNA, 24 bp, Homo sapiens
cctatcagaaaaaaattttcagag

SEQ ID NO: 47638 - DNA, 24 bp, Homo sapiens
tcctatcagaaaaaaattttcaga

SEQ ID NO: 47639 - DNA, 24 bp, Homo sapiens
gtcctatcagaaaaaaattttcag

SEQ ID NO: 47640 - DNA, 24 bp, Homo sapiens
gcaaccagtccacaataagcctgt

SEQ ID NO: 47641 - DNA, 24 bp, Homo sapiens
cgacatttccacacccagacccaa

SEQ ID NO: 47642 - DNA, 24 bp, Homo sapiens
ggagaggactattcacacaggagg

SEQ ID NO: 47643 - DNA, 23 bp, Homo sapiens
ttgtcttcagtaccaaggagctg

SEQ ID NO: 47644 - DNA, 23 bp, Homo sapiens
ttgcggcaagaacgtcactctag

SEQ ID NO: 47645 - DNA, 23 bp, Homo sapiens
tggctggcgtggctcaccgattc

SEQ ID NO: 47646 - DNA, 24 bp, Homo sapiens
cgcccacaagttcgtgctttatgc

SEQ ID NO: 47647 - DNA, 23 bp, Homo sapiens
ccacacctgagtgatgtccagtt

SEQ ID NO: 47648 - DNA, 23 bp, Homo sapiens
gggctgctggttgctgactttgg

SEQ ID NO: 47649 - DNA, 23 bp, Homo sapiens
cacctgccatgaggatgaccagc

SEQ ID NO: 47650 - DNA, 23 bp, Homo sapiens
atcggcggcggcagaaagagaag

SEQ ID NO: 47651 - DNA, 25 bp, Homo sapiens
ttattcttcattgtggtgctgctgg

SEQ ID NO: 47652 - DNA, 24 bp, Homo sapiens
cctgttggctactatggcgatggc

SEQ ID NO: 47653 - DNA, 24 bp, Homo sapiens
cctgtgacgctgacaacaccatca

SEQ ID NO: 47654 - DNA, 23 bp, Homo sapiens
ggtgcctgcgagtgtgagcctgg

SEQ ID NO: 47655 - DNA, 24 bp, Homo sapiens
ctttttcccagatgtagatgaatg

SEQ ID NO: 47656 - DNA, 24 bp, Homo sapiens
actttttcccagatgtagatgaat

SEQ ID NO: 47657 - DNA, 24 bp, Homo sapiens
tactttttcccagatgtagatgaa

SEQ ID NO: 47658 - DNA, 23 bp, Homo sapiens
cggtctctgtccagcagcagtga

SEQ ID NO: 47659 - DNA, 24 bp, Homo sapiens
aatgccgtatgcttgctcacctgt

SEQ ID NO: 47660 - DNA, 23 bp, Homo sapiens
gctccttccgctgccactgtcag

SEQ ID NO: 47661 - DNA, 24 bp, Homo sapiens
tggaggcagagccaggggtgctgc

SEQ ID NO: 47662 - DNA, 24 bp, Homo sapiens
ttggaggcagagccaggggtgctg

SEQ ID NO: 47663 - DNA, 24 bp, Homo sapiens
gttggaggcagagccaggggtgct

SEQ ID NO: 47664 - DNA, 24 bp, Homo sapiens
accgtctgggactatgacattggc

SEQ ID NO: 47665 - DNA, 24 bp, Homo sapiens
acttcattggtggcgtgtccctgg

SEQ ID NO: 47666 - DNA, 24 bp, Homo sapiens
gaggctcggaagcactggagtgac

SEQ ID NO: 47667 - DNA, 24 bp, Homo sapiens
ttaaaatacaggtttaaataacct

SEQ ID NO: 47668 - DNA, 24 bp, Homo sapiens
tttaaaatacaggtttaaataacc

SEQ ID NO: 47669 - DNA, 24 bp, Homo sapiens
ttttaaaatacaggtttaaataac

SEQ ID NO: 47670 - DNA, 24 bp, Homo sapiens
aatttaaagagggtaaaaaggaac

SEQ ID NO: 47671 - DNA, 24 bp, Homo sapiens
gaatttaaagagggtaaaaaggaa

SEQ ID NO: 47672 - DNA, 24 bp, Homo sapiens
agaatttaaagagggtaaaaagga

SEQ ID NO: 47673 - DNA, 24 bp, Homo sapiens
cggaagcccagatgctgcagaagc

SEQ ID NO: 47674 - DNA, 24 bp, Homo sapiens
tcggaagcccagatgctgcagaag

SEQ ID NO: 47675 - DNA, 24 bp, Homo sapiens
ctcggaagcccagatgctgcagaa

SEQ ID NO: 47676 - DNA, 24 bp, Homo sapiens
gttataaataggtaaagatgtctt

SEQ ID NO: 47677 - DNA, 24 bp, Homo sapiens
ggttataaataggtaaagatgtct

SEQ ID NO: 47678 - DNA, 24 bp, Homo sapiens
tggttataaataggtaaagatgtc

SEQ ID NO: 47679 - DNA, 24 bp, Homo sapiens
gcctggagactgatggtgaagagc

SEQ ID NO: 47680 - DNA, 23 bp, Homo sapiens
gcaggtggtggtgactctggatg

SEQ ID NO: 47681 - DNA, 23 bp, Homo sapiens
acggctgtcgaacttctggatgt

SEQ ID NO: 47682 - DNA, 24 bp, Homo sapiens
attcatgcaagtgtcctgtgcctg

SEQ ID NO: 47683 - DNA, 24 bp, Homo sapiens
tattcatgcaagtgtcctgtgcct

SEQ ID NO: 47684 - DNA, 24 bp, Homo sapiens
atattcatgcaagtgtcctgtgcc

SEQ ID NO: 47685 - DNA, 23 bp, Homo sapiens
gccttgctggtgctgtgctattc

SEQ ID NO: 47686 - DNA, 23 bp, Homo sapiens
gcctggaagtacatggaggagga

SEQ ID NO: 47687 - DNA, 24 bp, Homo sapiens
tggtttcgggaagtcggtctgtga

SEQ ID NO: 47688 - DNA, 24 bp, Homo sapiens
cacaggaagaggatggtaaaccta

SEQ ID NO: 47689 - DNA, 24 bp, Homo sapiens
tcacaggaagaggatggtaaacct

SEQ ID NO: 47690 - DNA, 24 bp, Homo sapiens
ctcacaggaagaggatggtaaacc

SEQ ID NO: 47691 - DNA, 24 bp, Homo sapiens
ttgaggatgtggctgtggacttca

SEQ ID NO: 47692 - DNA, 25 bp, Homo sapiens
cgcttgatgacagatgagtaatgcc

SEQ ID NO: 47693 - DNA, 24 bp, Homo sapiens
aagaggaaaggatggtggctgggt

SEQ ID NO: 47694 - DNA, 24 bp, Homo sapiens
gatgcggtcttgctgtgttgccta

SEQ ID NO: 47695 - DNA, 24 bp, Homo sapiens
tgctctcaagtgatcctcctgcct

SEQ ID NO: 47696 - DNA, 23 bp, Homo sapiens
gctctgcctgcttaggactctgc

SEQ ID NO: 47697 - DNA, 24 bp, Homo sapiens
gggcttcgtctttcactccttcgg

SEQ ID NO: 47698 - DNA, 24 bp, Homo sapiens
ccctccccttgtcccctgcccctt

SEQ ID NO: 47699 - DNA, 24 bp, Homo sapiens
cgccgccgcctccgcccaccttcc

SEQ ID NO: 47700 - DNA, 23 bp, Homo sapiens
ctggcaagatcggctggttcctg

SEQ ID NO: 47701 - DNA, 23 bp, Homo sapiens
cctaccacaccgtctgggactgc

SEQ ID NO: 47702 - DNA, 23 bp, Homo sapiens
gcagcagcagcagcacagccagg

SEQ ID NO: 47703 - DNA, 23 bp, Homo sapiens
agatggtgctggtgctggtggta

SEQ ID NO: 47704 - DNA, 25 bp, Homo sapiens
tggtgaacttacagatggaacagcc

SEQ ID NO: 47705 - DNA, 23 bp, Homo sapiens
gccagcagcagcattaacccttt

SEQ ID NO: 47706 - DNA, 24 bp, Homo sapiens
tgttttacagggagaattttttct

SEQ ID NO: 47707 - DNA, 24 bp, Homo sapiens
atgttttacagggagaattttttc

SEQ ID NO: 47708 - DNA, 24 bp, Homo sapiens
tatgttttacagggagaatttttt

SEQ ID NO: 47709 - DNA, 24 bp, Homo sapiens
tggattcactagtaagtattgact

SEQ ID NO: 47710 - DNA, 24 bp, Homo sapiens
atggattcactagtaagtattgac

SEQ ID NO: 47711 - DNA, 24 bp, Homo sapiens
aatggattcactagtaagtattga

SEQ ID NO: 47712 - DNA, 24 bp, Homo sapiens
gatgttatcagacttgttgaattt

SEQ ID NO: 47713 - DNA, 24 bp, Homo sapiens
agatgttatcagacttgttgaatt

SEQ ID NO: 47714 - DNA, 24 bp, Homo sapiens
aagatgttatcagacttgttgaat

SEQ ID NO: 47715 - DNA, 24 bp, Homo sapiens
ttacatttgagattctgctggttc

SEQ ID NO: 47716 - DNA, 24 bp, Homo sapiens
cttacatttgagattctgctggtt

SEQ ID NO: 47717 - DNA, 24 bp, Homo sapiens
tcttacatttgagattctgctggt

SEQ ID NO: 47718 - DNA, 24 bp, Homo sapiens
ctaaagcgacagtaagtatttgga

SEQ ID NO: 47719 - DNA, 24 bp, Homo sapiens
actaaagcgacagtaagtatttgg

SEQ ID NO: 47720 - DNA, 24 bp, Homo sapiens
cactaaagcgacagtaagtatttg

SEQ ID NO: 47721 - DNA, 24 bp, Homo sapiens
tcactgtccagcttgccaatgcaa

SEQ ID NO: 47722 - DNA, 24 bp, Homo sapiens
ttcactgtccagcttgccaatgca

SEQ ID NO: 47723 - DNA, 24 bp, Homo sapiens
attcactgtccagcttgccaatgc

SEQ ID NO: 47724 - DNA, 25 bp, Homo sapiens
tggacctggtacagttcttcgtgac

SEQ ID NO: 47725 - DNA, 23 bp, Homo sapiens
ttgctcctggtggctgctgtggt

SEQ ID NO: 47726 - DNA, 25 bp, Homo sapiens
agccgtccctttgcctctgtaaatg

SEQ ID NO: 47727 - DNA, 24 bp, Homo sapiens
acttccgccccgtatcatccatca

SEQ ID NO: 47728 - DNA, 23 bp, Homo sapiens
gggctgctggctgtgaatgacga

SEQ ID NO: 47729 - DNA, 23 bp, Homo sapiens
ggaggtgaacggcattgaggtgg

SEQ ID NO: 47730 - DNA, 23 bp, Homo sapiens
gcatctccttcttcggctggtgg

SEQ ID NO: 47731 - DNA, 23 bp, Homo sapiens
ccttcctcctcctcctcctctgc

SEQ ID NO: 47732 - DNA, 23 bp, Homo sapiens
gtgcgtggtggatctgagctgga

SEQ ID NO: 47733 - DNA, 24 bp, Homo sapiens
ctggagagtggtgctgggatgttc

SEQ ID NO: 47734 - DNA, 24 bp, Homo sapiens
tcctcacactatcagtaccagcga

SEQ ID NO: 47735 - DNA, 24 bp, Homo sapiens
ctacagcatcctcatcttcatggc

SEQ ID NO: 47736 - DNA, 23 bp, Homo sapiens
gtgctgtttgggacctgggatgg

SEQ ID NO: 47737 - DNA, 23 bp, Homo sapiens
cctgaggactggctggctggtgg

SEQ ID NO: 47738 - DNA, 25 bp, Homo sapiens
tgttcctggtgtccttcgtcatcct

SEQ ID NO: 47739 - DNA, 25 bp, Homo sapiens
tggctaaggttgacatggagatgac

SEQ ID NO: 47740 - DNA, 23 bp, Homo sapiens
ccaggagaatgcagacttcgcca

SEQ ID NO: 47741 - DNA, 23 bp, Homo sapiens
atcgctaccaccactcctccctc

SEQ ID NO: 47742 - DNA, 23 bp, Homo sapiens
gctgctgttgctgttcctgctgg

SEQ ID NO: 47743 - DNA, 23 bp, Homo sapiens
ctcgggaatatctgggctgtgcg

SEQ ID NO: 47744 - DNA, 23 bp, Homo sapiens
cggctttgctgaatccatctcgg

SEQ ID NO: 47745 - DNA, 24 bp, Homo sapiens
caaggagcaaggttcggaaatgaa

SEQ ID NO: 47746 - DNA, 24 bp, Homo sapiens
tcaaggagcaaggttcggaaatga

SEQ ID NO: 47747 - DNA, 24 bp, Homo sapiens
ctcaaggagcaaggttcggaaatg

SEQ ID NO: 47748 - DNA, 23 bp, Homo sapiens
ccaccaaccaccactgagccttc

SEQ ID NO: 47749 - DNA, 23 bp, Homo sapiens
ccgagggtgatcccagaggaagg

SEQ ID NO: 47750 - DNA, 25 bp, Homo sapiens
tcctgaagaagaatttgatctggct

SEQ ID NO: 47751 - DNA, 23 bp, Homo sapiens
cactgcctggagagcgccctgag

SEQ ID NO: 47752 - DNA, 23 bp, Homo sapiens
cctgtaaggcccttgcgcttcgc

SEQ ID NO: 47753 - DNA, 23 bp, Homo sapiens
ccccagccccagccccagccccg

SEQ ID NO: 47754 - DNA, 24 bp, Homo sapiens
tggtagagttctcagccttcgtgg

SEQ ID NO: 47755 - DNA, 24 bp, Homo sapiens
ttcttaccagaggcacctgttcgt

SEQ ID NO: 47756 - DNA, 24 bp, Homo sapiens
cctctcacccctgcccccacctac

SEQ ID NO: 47757 - DNA, 24 bp, Homo sapiens
gctggaaggtgctgaaaaagatcg

SEQ ID NO: 47758 - DNA, 24 bp, Homo sapiens
cgctggaaggtgctgaaaaagatc

SEQ ID NO: 47759 - DNA, 24 bp, Homo sapiens
tcgctggaaggtgctgaaaaagat

SEQ ID NO: 47760 - DNA, 23 bp, Homo sapiens
ctagccaggaccgccaggaggag

SEQ ID NO: 47761 - DNA, 23 bp, Homo sapiens
ggtggagcctaccgaggaagcca

SEQ ID NO: 47762 - DNA, 25 bp, Homo sapiens
aatctgaccgagtgtacctggacct

SEQ ID NO: 47763 - DNA, 24 bp, Homo sapiens
gggaaggacatggaggaacggaaa

SEQ ID NO: 47764 - DNA, 23 bp, Homo sapiens
ctcctgcacgacagaaggctcca

SEQ ID NO: 47765 - DNA, 23 bp, Homo sapiens
aacaaagactccaaaatatcttt

SEQ ID NO: 47766 - DNA, 23 bp, Homo sapiens
cgctcatctggctctgctacgac

SEQ ID NO: 47767 - DNA, 23 bp, Homo sapiens
gcgtcggaagcctgaagcatggg

SEQ ID NO: 47768 - DNA, 25 bp, Homo sapiens
gcccttttgtctacttgtctttagt

SEQ ID NO: 47769 - DNA, 23 bp, Homo sapiens
cgctcatctggctctgctacgac

SEQ ID NO: 47770 - DNA, 23 bp, Homo sapiens
gcgtcggaagcctgaagcatggg

SEQ ID NO: 47771 - DNA, 23 bp, Homo sapiens
gaggctggcggttcgctgctgct

SEQ ID NO: 47772 - DNA, 23 bp, Homo sapiens
ggcagcatcacacccacagacaa

SEQ ID NO: 47773 - DNA, 23 bp, Homo sapiens
gtgactgtctggaaccgcactgc

SEQ ID NO: 47774 - DNA, 23 bp, Homo sapiens
ccgctgaagtcgtctcaacctgc

SEQ ID NO: 47775 - DNA, 23 bp, Homo sapiens
ccaagaggcgtgaagcggagcag

SEQ ID NO: 47776 - DNA, 25 bp, Homo sapiens
acggagcagagaagttccagaagga

SEQ ID NO: 47777 - DNA, 23 bp, Homo sapiens
gaggcggctggtggagacactac

SEQ ID NO: 47778 - DNA, 24 bp, Homo sapiens
agaaataacagaactttcctcagg

SEQ ID NO: 47779 - DNA, 24 bp, Homo sapiens
tagaaataacagaactttcctcag

SEQ ID NO: 47780 - DNA, 24 bp, Homo sapiens
ttagaaataacagaactttcctca

SEQ ID NO: 47781 - DNA, 24 bp, Homo sapiens
tgaatattcaggtaattcttttaa

SEQ ID NO: 47782 - DNA, 24 bp, Homo sapiens
ttgaatattcaggtaattctttta

SEQ ID NO: 47783 - DNA, 24 bp, Homo sapiens
attgaatattcaggtaattctttt

SEQ ID NO: 47784 - DNA, 24 bp, Homo sapiens
atgaatggaaggtattggaaggga

SEQ ID NO: 47785 - DNA, 24 bp, Homo sapiens
aatgaatggaaggtattggaaggg

SEQ ID NO: 47786 - DNA, 24 bp, Homo sapiens
gaatgaatggaaggtattggaagg

SEQ ID NO: 47787 - DNA, 24 bp, Homo sapiens
ccttccttcactgtagtgccagaa

SEQ ID NO: 47788 - DNA, 24 bp, Homo sapiens
ggctgttcccacctcaaaccactt

SEQ ID NO: 47789 - DNA, 24 bp, Homo sapiens
ttgtcacggttgctatgggaaaga

SEQ ID NO: 47790 - DNA, 24 bp, Homo sapiens
cgagaggctggaacagttgaggga

SEQ ID NO: 47791 - DNA, 24 bp, Homo sapiens
ttgctcatcatcaccaggcgtgct

SEQ ID NO: 47792 - DNA, 24 bp, Homo sapiens
aatttccactctgtttactcccaa

SEQ ID NO: 47793 - DNA, 24 bp, Homo sapiens
cttaaggcatgaaagaaaaaaggt

SEQ ID NO: 47794 - DNA, 24 bp, Homo sapiens
gcttaaggcatgaaagaaaaaagg

SEQ ID NO: 47795 - DNA, 24 bp, Homo sapiens
ggcttaaggcatgaaagaaaaaag

SEQ ID NO: 47796 - DNA, 24 bp, Homo sapiens
ttaaactttaggtctattgttgcc

SEQ ID NO: 47797 - DNA, 24 bp, Homo sapiens
tttaaactttaggtctattgttgc

SEQ ID NO: 47798 - DNA, 24 bp, Homo sapiens
ttttaaactttaggtctattgttg

SEQ ID NO: 47799 - DNA, 24 bp, Homo sapiens
cggatttacaggtgttgtagctgt

SEQ ID NO: 47800 - DNA, 24 bp, Homo sapiens
gcggatttacaggtgttgtagctg

SEQ ID NO: 47801 - DNA, 24 bp, Homo sapiens
tgcggatttacaggtgttgtagct

SEQ ID NO: 47802 - DNA, 24 bp, Homo sapiens
tctacctacaggtaagaaaattaa

SEQ ID NO: 47803 - DNA, 24 bp, Homo sapiens
ctctacctacaggtaagaaaatta

SEQ ID NO: 47804 - DNA, 24 bp, Homo sapiens
cctctacctacaggtaagaaaatt

SEQ ID NO: 47805 - DNA, 24 bp, Homo sapiens
ttacttatttggtgagccattaat

SEQ ID NO: 47806 - DNA, 24 bp, Homo sapiens
tttacttatttggtgagccattaa

SEQ ID NO: 47807 - DNA, 24 bp, Homo sapiens
ttttacttatttggtgagccatta

SEQ ID NO: 47808 - DNA, 23 bp, Homo sapiens
ctaattctgaatgacaatggcaa

SEQ ID NO: 47809 - DNA, 24 bp, Homo sapiens
attggtgaaatgaatgaatacagg

SEQ ID NO: 47810 - DNA, 25 bp, Homo sapiens
ggttgattatggagaattcaaacgt

SEQ ID NO: 47811 - DNA, 24 bp, Homo sapiens
tccattataaggtatgtgttacct

SEQ ID NO: 47812 - DNA, 24 bp, Homo sapiens
ttccattataaggtatgtgttacc

SEQ ID NO: 47813 - DNA, 24 bp, Homo sapiens
attccattataaggtatgtgttac

SEQ ID NO: 47814 - DNA, 23 bp, Homo sapiens
atccagccaccaccaccaccatc

SEQ ID NO: 47815 - DNA, 24 bp, Homo sapiens
ttgaagtcaccagcgatgagcagc

SEQ ID NO: 47816 - DNA, 23 bp, Homo sapiens
accaccaccaccgccacctcatc

SEQ ID NO: 47817 - DNA, 24 bp, Homo sapiens
actcagaccaggctcctgaggaca

SEQ ID NO: 47818 - DNA, 24 bp, Homo sapiens
gactcagaccaggctcctgaggac

SEQ ID NO: 47819 - DNA, 24 bp, Homo sapiens
agactcagaccaggctcctgagga

SEQ ID NO: 47820 - DNA, 25 bp, Homo sapiens
gtcctggttgagctgtactctgtcc

SEQ ID NO: 47821 - DNA, 23 bp, Homo sapiens
cagccaccagcagccgcatcctc

SEQ ID NO: 47822 - DNA, 25 bp, Homo sapiens
acagatactatgaggactccttctc

SEQ ID NO: 47823 - DNA, 25 bp, Homo sapiens
ccgtgagaaagtgacccaggagaac

SEQ ID NO: 47824 - DNA, 23 bp, Homo sapiens
aaaggagcaggaagcctcacagc

SEQ ID NO: 47825 - DNA, 24 bp, Homo sapiens
caggtggagatgctacaggaccat

SEQ ID NO: 47826 - DNA, 25 bp, Homo sapiens
tcagtgtcaacgaatccagtgtcct

SEQ ID NO: 47827 - DNA, 24 bp, Homo sapiens
gcctgatctgattgtcctccagcc

SEQ ID NO: 47828 - DNA, 23 bp, Homo sapiens
gatggcaggcagtgtggatggca

SEQ ID NO: 47829 - DNA, 23 bp, Homo sapiens
cgctggacttcaacgctacaggc

SEQ ID NO: 47830 - DNA, 25 bp, Homo sapiens
gatgctggctggattggacttggat

SEQ ID NO: 47831 - DNA, 24 bp, Homo sapiens
gcaccagatggcagatagcagctc

SEQ ID NO: 47832 - DNA, 23 bp, Homo sapiens
ggcgaggatgacaacctggagga

SEQ ID NO: 47833 - DNA, 23 bp, Homo sapiens
gctgaacctgaccgaagtggagg

SEQ ID NO: 47834 - DNA, 23 bp, Homo sapiens
ggcggaggcaggcgagttcacta

SEQ ID NO: 47835 - DNA, 23 bp, Homo sapiens
caaggcaccagcaccacctccag

SEQ ID NO: 47836 - DNA, 23 bp, Homo sapiens
cctcggccactacaagcagtcaa

SEQ ID NO: 47837 - DNA, 25 bp, Homo sapiens
acatcatcttccaggacttctgtgt

SEQ ID NO: 47838 - DNA, 24 bp, Homo sapiens
tttggaggaagatgtaaggtttat

SEQ ID NO: 47839 - DNA, 24 bp, Homo sapiens
atttggaggaagatgtaaggttta

SEQ ID NO: 47840 - DNA, 24 bp, Homo sapiens
gatttggaggaagatgtaaggttt

SEQ ID NO: 47841 - DNA, 24 bp, Homo sapiens
ccattcataaggattcagggaata

SEQ ID NO: 47842 - DNA, 24 bp, Homo sapiens
tccattcataaggattcagggaat

SEQ ID NO: 47843 - DNA, 24 bp, Homo sapiens
ttccattcataaggattcagggaa

SEQ ID NO: 47844 - DNA, 24 bp, Homo sapiens
tggaaaaacaggtaacaaatgctt

SEQ ID NO: 47845 - DNA, 24 bp, Homo sapiens
gtggaaaaacaggtaacaaatgct

SEQ ID NO: 47846 - DNA, 24 bp, Homo sapiens
ggtggaaaaacaggtaacaaatgc

SEQ ID NO: 47847 - DNA, 25 bp, Homo sapiens
aagtcttccagtacattgacctcca

SEQ ID NO: 47848 - DNA, 23 bp, Homo sapiens
gtgctgctgctgctgctggagcg

SEQ ID NO: 47849 - DNA, 23 bp, Homo sapiens
gttctcctcaccctccccgcccc

SEQ ID NO: 47850 - DNA, 23 bp, Homo sapiens
ctgtgctgctgctgctgctggag

SEQ ID NO: 47851 - DNA, 23 bp, Homo sapiens
caaactcgggagaatggctgcgt

SEQ ID NO: 47852 - DNA, 25 bp, Homo sapiens
gttgctagaggcttcagaactccag

SEQ ID NO: 47853 - DNA, 24 bp, Homo sapiens
gacagtttctattatttgtataaa

SEQ ID NO: 47854 - DNA, 24 bp, Homo sapiens
ggacagtttctattatttgtataa

SEQ ID NO: 47855 - DNA, 24 bp, Homo sapiens
gggacagtttctattatttgtata

SEQ ID NO: 47856 - DNA, 24 bp, Homo sapiens
tcttcatactttctgcaagagttg

SEQ ID NO: 47857 - DNA, 24 bp, Homo sapiens
gtcttcatactttctgcaagagtt

SEQ ID NO: 47858 - DNA, 24 bp, Homo sapiens
tgtcttcatactttctgcaagagt

SEQ ID NO: 47859 - DNA, 24 bp, Homo sapiens
tatgtacacagagacattaaacct

SEQ ID NO: 47860 - DNA, 24 bp, Homo sapiens
ttatgtacacagagacattaaacc

SEQ ID NO: 47861 - DNA, 24 bp, Homo sapiens
attatgtacacagagacattaaac

SEQ ID NO: 47862 - DNA, 24 bp, Homo sapiens
ataatttaaaggaaaaccagcaga

SEQ ID NO: 47863 - DNA, 24 bp, Homo sapiens
aataatttaaaggaaaaccagcag

SEQ ID NO: 47864 - DNA, 24 bp, Homo sapiens
taataatttaaaggaaaaccagca

SEQ ID NO: 47865 - DNA, 24 bp, Homo sapiens
atctcatttaggttttgttatcca

SEQ ID NO: 47866 - DNA, 24 bp, Homo sapiens
aatctcatttaggttttgttatcc

SEQ ID NO: 47867 - DNA, 24 bp, Homo sapiens
aaatctcatttaggttttgttatc

SEQ ID NO: 47868 - DNA, 24 bp, Homo sapiens
catcaaccatgactgcaaacccaa

SEQ ID NO: 47869 - DNA, 24 bp, Homo sapiens
tcatcaaccatgactgcaaaccca

SEQ ID NO: 47870 - DNA, 24 bp, Homo sapiens
ttcatcaaccatgactgcaaaccc

SEQ ID NO: 47871 - DNA, 23 bp, Homo sapiens
cggtgagaatgacttcagcatca

SEQ ID NO: 47872 - DNA, 23 bp, Homo sapiens
gcccagccgccttcatcaaccat

SEQ ID NO: 47873 - DNA, 24 bp, Homo sapiens
gacgaggtgacatgcttctacggc

SEQ ID NO: 47874 - DNA, 24 bp, Homo sapiens
caaatatgaaggtaaacacaaacg

SEQ ID NO: 47875 - DNA, 24 bp, Homo sapiens
gcaaatatgaaggtaaacacaaac

SEQ ID NO: 47876 - DNA, 24 bp, Homo sapiens
ggcaaatatgaaggtaaacacaaa

SEQ ID NO: 47877 - DNA, 24 bp, Homo sapiens
gctgaaggcaggccgcatcctggg

SEQ ID NO: 47878 - DNA, 24 bp, Homo sapiens
tgctgaaggcaggccgcatcctgg

SEQ ID NO: 47879 - DNA, 24 bp, Homo sapiens
ctgctgaaggcaggccgcatcctg

SEQ ID NO: 47880 - DNA, 23 bp, Homo sapiens
gtgcagcttcaagcttaggacca

SEQ ID NO: 47881 - DNA, 23 bp, Homo sapiens
ctctgttagcttggcctctgtcc

SEQ ID NO: 47882 - DNA, 23 bp, Homo sapiens
gcttcccaaagtgctgaggttgc

SEQ ID NO: 47883 - DNA, 23 bp, Homo sapiens
ttcggtcttcggagtgtctctgg

SEQ ID NO: 47884 - DNA, 23 bp, Homo sapiens
gacgctggttctcggcttcatcc

SEQ ID NO: 47885 - DNA, 23 bp, Homo sapiens
ctccactgcggacctctcctgag

SEQ ID NO: 47886 - DNA, 24 bp, Homo sapiens
agggcatggaggctggaccctgga

SEQ ID NO: 47887 - DNA, 24 bp, Homo sapiens
cagggcatggaggctggaccctgg

SEQ ID NO: 47888 - DNA, 24 bp, Homo sapiens
ccagggcatggaggctggaccctg

SEQ ID NO: 47889 - DNA, 24 bp, Homo sapiens
gggcaacagagcgagactccatct

SEQ ID NO: 47890 - DNA, 24 bp, Homo sapiens
gacaaggtgctccacgagaaggac

SEQ ID NO: 47891 - DNA, 24 bp, Homo sapiens
gcgacctggacaaggctgacctca

SEQ ID NO: 47892 - DNA, 24 bp, Homo sapiens
aagaacttgaggtaattgttaagc

SEQ ID NO: 47893 - DNA, 24 bp, Homo sapiens
aaagaacttgaggtaattgttaag

SEQ ID NO: 47894 - DNA, 24 bp, Homo sapiens
gaaagaacttgaggtaattgttaa

SEQ ID NO: 47895 - DNA, 24 bp, Homo sapiens
ttttttaatagctgagaagcttca

SEQ ID NO: 47896 - DNA, 24 bp, Homo sapiens
attttttaatagctgagaagcttc

SEQ ID NO: 47897 - DNA, 24 bp, Homo sapiens
tattttttaatagctgagaagctt

SEQ ID NO: 47898 - DNA, 24 bp, Homo sapiens
ttcctctccagatttgattttatc

SEQ ID NO: 47899 - DNA, 24 bp, Homo sapiens
cttcctctccagatttgattttat

SEQ ID NO: 47900 - DNA, 24 bp, Homo sapiens
tcttcctctccagatttgatttta

SEQ ID NO: 47901 - DNA, 25 bp, Homo sapiens
cgctttccctcatcctccttctcaa

SEQ ID NO: 47902 - DNA, 24 bp, Homo sapiens
agggtggctgaggctcttgaaaca

SEQ ID NO: 47903 - DNA, 23 bp, Homo sapiens
ctcctctactcagccgatgactc

SEQ ID NO: 47904 - DNA, 23 bp, Homo sapiens
ctcctctactcagccgatgactc

SEQ ID NO: 47905 - DNA, 23 bp, Homo sapiens
ctgtggagccgtcgtgaactgag

SEQ ID NO: 47906 - DNA, 23 bp, Homo sapiens
ggcgtggtggtcttgctcttctc

SEQ ID NO: 47907 - DNA, 24 bp, Homo sapiens
ctgcggctgctgctgctgctctgg

SEQ ID NO: 47908 - DNA, 24 bp, Homo sapiens
cccagggccacctaaggagcggac

SEQ ID NO: 47909 - DNA, 24 bp, Homo sapiens
gggccacgggatgacgcctcctcc

SEQ ID NO: 47910 - DNA, 24 bp, Homo sapiens
aggacttcctggacctgctcttcc

SEQ ID NO: 47911 - DNA, 24 bp, Homo sapiens
cgaacctgctcaagctcttcctgg

SEQ ID NO: 47912 - DNA, 24 bp, Homo sapiens
gaggagacaaccagcaccgagtgt

SEQ ID NO: 47913 - DNA, 24 bp, Homo sapiens
ggttgaagcaggttttatgacaac

SEQ ID NO: 47914 - DNA, 24 bp, Homo sapiens
tggttgaagcaggttttatgacaa

SEQ ID NO: 47915 - DNA, 24 bp, Homo sapiens
gtggttgaagcaggttttatgaca

SEQ ID NO: 47916 - DNA, 24 bp, Homo sapiens
caccctggagagccctggtgagtg

SEQ ID NO: 47917 - DNA, 24 bp, Homo sapiens
acaccctggagagccctggtgagt

SEQ ID NO: 47918 - DNA, 24 bp, Homo sapiens
gacaccctggagagccctggtgag

SEQ ID NO: 47919 - DNA, 24 bp, Homo sapiens
tttaataagagagcaaagcagtac

SEQ ID NO: 47920 - DNA, 24 bp, Homo sapiens
atttaataagagagcaaagcagta

SEQ ID NO: 47921 - DNA, 24 bp, Homo sapiens
aatttaataagagagcaaagcagt

SEQ ID NO: 47922 - DNA, 23 bp, Homo sapiens
cttcaccagcacagcagcagcag

SEQ ID NO: 47923 - DNA, 23 bp, Homo sapiens
tcctccgagacctggcagaacct

SEQ ID NO: 47924 - DNA, 23 bp, Homo sapiens
ggctcgcttctctgtactgctgc

SEQ ID NO: 47925 - DNA, 25 bp, Homo sapiens
ctcagcgagattactggaggattag

SEQ ID NO: 47926 - DNA, 23 bp, Homo sapiens
ggatgtccccgcccgcctctggt

SEQ ID NO: 47927 - DNA, 23 bp, Homo sapiens
ctgctctgacaggctcgccccgc

SEQ ID NO: 47928 - DNA, 25 bp, Homo sapiens
ttgatggaacttgatgtgagctgca

SEQ ID NO: 47929 - DNA, 25 bp, Homo sapiens
gcggagttgcctttgatacggttag

SEQ ID NO: 47930 - DNA, 24 bp, Homo sapiens
tcggaacctcaggcacctacagac

SEQ ID NO: 47931 - DNA, 24 bp, Homo sapiens
ggcggcaccaggccacagttgtaa

SEQ ID NO: 47932 - DNA, 24 bp, Homo sapiens
cggcggcaccaggccacagttgta

SEQ ID NO: 47933 - DNA, 24 bp, Homo sapiens
gcggcggcaccaggccacagttgt

SEQ ID NO: 47934 - DNA, 24 bp, Homo sapiens
gctccacacaggtgtatgcccacg

SEQ ID NO: 47935 - DNA, 24 bp, Homo sapiens
ggctccacacaggtgtatgcccac

SEQ ID NO: 47936 - DNA, 24 bp, Homo sapiens
tggctccacacaggtgtatgccca

SEQ ID NO: 47937 - DNA, 24 bp, Homo sapiens
ctccggcacacactgctgctcctg

SEQ ID NO: 47938 - DNA, 24 bp, Homo sapiens
ccaccatggcgctgcctccaggcc

SEQ ID NO: 47939 - DNA, 24 bp, Homo sapiens
ctcggggagggagccagcagccta

SEQ ID NO: 47940 - DNA, 24 bp, Homo sapiens
tccagccccaggcccctcccggca

SEQ ID NO: 47941 - DNA, 24 bp, Homo sapiens
ttccagccccaggcccctcccggc

SEQ ID NO: 47942 - DNA, 24 bp, Homo sapiens
cttccagccccaggcccctcccgg

SEQ ID NO: 47943 - DNA, 25 bp, Homo sapiens
cctacatcaatgccaactacatccg

SEQ ID NO: 47944 - DNA, 23 bp, Homo sapiens
gcaggagcacacgcccatcattg

SEQ ID NO: 47945 - DNA, 24 bp, Homo sapiens
acgacggtgttgagatcactgtgc

SEQ ID NO: 47946 - DNA, 24 bp, Homo sapiens
ttggttagcaggtatagttaatcc

SEQ ID NO: 47947 - DNA, 24 bp, Homo sapiens
cttggttagcaggtatagttaatc

SEQ ID NO: 47948 - DNA, 24 bp, Homo sapiens
gcttggttagcaggtatagttaat

SEQ ID NO: 47949 - DNA, 25 bp, Homo sapiens
accgagcccatcttcttctccttct

SEQ ID NO: 47950 - DNA, 25 bp, Homo sapiens
ggctcccatagttctcatcctgctg

SEQ ID NO: 47951 - DNA, 24 bp, Homo sapiens
gagaggcggcggcagaataagaag

SEQ ID NO: 47952 - DNA, 23 bp, Homo sapiens
gagaggcggcggcagaataagaa

SEQ ID NO: 47953 - DNA, 24 bp, Homo sapiens
gctcccatagttctcatcctgctg

SEQ ID NO: 47954 - DNA, 23 bp, Homo sapiens
agtttacactgaacatgctcgtg

SEQ ID NO: 47955 - DNA, 23 bp, Homo sapiens
ccgtggagacagggttcgccaaa

SEQ ID NO: 47956 - DNA, 25 bp, Homo sapiens
actcggtgactttcaaggacaactt

SEQ ID NO: 47957 - DNA, 23 bp, Homo sapiens
cgggatcgcagcagccagccagc

SEQ ID NO: 47958 - DNA, 24 bp, Homo sapiens
tgctttctggagacctggtgtgga

SEQ ID NO: 47959 - DNA, 23 bp, Homo sapiens
gttgtgctgctcctgctgctcat

SEQ ID NO: 47960 - DNA, 25 bp, Homo sapiens
tcattgtggtcatctggagacagcc

SEQ ID NO: 47961 - DNA, 25 bp, Homo sapiens
gcacagcctggaagagattaagagt

SEQ ID NO: 47962 - DNA, 25 bp, Homo sapiens
cggcactctctatgtccactcagtt

SEQ ID NO: 47963 - DNA, 24 bp, Homo sapiens
cctgtgatggtggtggtggatact

SEQ ID NO: 47964 - DNA, 23 bp, Homo sapiens
ggaattgcctgcggaagagcctt

SEQ ID NO: 47965 - DNA, 25 bp, Homo sapiens
ccagaggagagttcccgagatcagg

SEQ ID NO: 47966 - DNA, 23 bp, Homo sapiens
gctgtgctggagtgcctgacctt

SEQ ID NO: 47967 - DNA, 23 bp, Homo sapiens
ggaggaggtggtgctgctgctcg

SEQ ID NO: 47968 - DNA, 23 bp, Homo sapiens
agttcctgagtgtgctgcctccg

SEQ ID NO: 47969 - DNA, 23 bp, Homo sapiens
acagatcctggagctgctggtgc

SEQ ID NO: 47970 - DNA, 24 bp, Homo sapiens
ccagcatctctgcctgtgtagtgg

SEQ ID NO: 47971 - DNA, 23 bp, Homo sapiens
atcctgacctcgtgatccacccg

SEQ ID NO: 47972 - DNA, 24 bp, Homo sapiens
cattttcccagagcccttccccag

SEQ ID NO: 47973 - DNA, 23 bp, Homo sapiens
atctccgctcaccgcaacctcca

SEQ ID NO: 47974 - DNA, 23 bp, Homo sapiens
atctcctgacctcgtgatccgcc

SEQ ID NO: 47975 - DNA, 24 bp, Homo sapiens
acacatctgacctcactagccagc

SEQ ID NO: 47976 - DNA, 24 bp, Homo sapiens
agatgaaataggtcatagtaatgg

SEQ ID NO: 47977 - DNA, 24 bp, Homo sapiens
tagatgaaataggtcatagtaatg

SEQ ID NO: 47978 - DNA, 24 bp, Homo sapiens
atagatgaaataggtcatagtaat

SEQ ID NO: 47979 - DNA, 25 bp, Homo sapiens
ttattatattcacatttttacttaa

SEQ ID NO: 47980 - DNA, 24 bp, Homo sapiens
aaacttcaaaggtaaaaatataat

SEQ ID NO: 47981 - DNA, 24 bp, Homo sapiens
taaacttcaaaggtaaaaatataa

SEQ ID NO: 47982 - DNA, 24 bp, Homo sapiens
gtaaacttcaaaggtaaaaatata

SEQ ID NO: 47983 - DNA, 24 bp, Homo sapiens
tgaatttaaagatataactggtag

SEQ ID NO: 47984 - DNA, 24 bp, Homo sapiens
ctgaatttaaagatataactggta

SEQ ID NO: 47985 - DNA, 24 bp, Homo sapiens
tctgaatttaaagatataactggt

SEQ ID NO: 47986 - DNA, 23 bp, Homo sapiens
tctggtggctgagtgctgtggct

SEQ ID NO: 47987 - DNA, 24 bp, Homo sapiens
aacacctccaggaatgagcaactc

SEQ ID NO: 47988 - DNA, 25 bp, Homo sapiens
acctcagagaatcacaatcctagtc

SEQ ID NO: 47989 - DNA, 24 bp, Homo sapiens
aattattacaggtattatttttgc

SEQ ID NO: 47990 - DNA, 24 bp, Homo sapiens
aaattattacaggtattatttttg

SEQ ID NO: 47991 - DNA, 24 bp, Homo sapiens
aaaattattacaggtattattttt

SEQ ID NO: 47992 - DNA, 24 bp, Homo sapiens
agagataacctttggccaagtgaa

SEQ ID NO: 47993 - DNA, 24 bp, Homo sapiens
cagagataacctttggccaagtga

SEQ ID NO: 47994 - DNA, 24 bp, Homo sapiens
tcagagataacctttggccaagtg

SEQ ID NO: 47995 - DNA, 24 bp, Homo sapiens
atgcttggactgttgtataaaaat

SEQ ID NO: 47996 - DNA, 24 bp, Homo sapiens
tatgcttggactgttgtataaaaa

SEQ ID NO: 47997 - DNA, 24 bp, Homo sapiens
gtatgcttggactgttgtataaaa

SEQ ID NO: 47998 - DNA, 24 bp, Homo sapiens
gaactggacgcctatgccgagaag

SEQ ID NO: 47999 - DNA, 23 bp, Homo sapiens
cacctcagccgcacagtcaatgg

SEQ ID NO: 48000 - DNA, 23 bp, Homo sapiens
gcggtttcctcctccagcacggc

SEQ ID NO: 48001 - DNA, 24 bp, Homo sapiens
cttggctacaacattatttgcaat

SEQ ID NO: 48002 - DNA, 24 bp, Homo sapiens
gcttggctacaacattatttgcaa

SEQ ID NO: 48003 - DNA, 24 bp, Homo sapiens
agcttggctacaacattatttgca

SEQ ID NO: 48004 - DNA, 24 bp, Homo sapiens
ggtttcaatggggcattctatttc

SEQ ID NO: 48005 - DNA, 24 bp, Homo sapiens
tggtttcaatggggcattctattt

SEQ ID NO: 48006 - DNA, 24 bp, Homo sapiens
ctggtttcaatggggcattctatt

SEQ ID NO: 48007 - DNA, 24 bp, Homo sapiens
attattttgaggtgtctattgtgg

SEQ ID NO: 48008 - DNA, 24 bp, Homo sapiens
aattattttgaggtgtctattgtg

SEQ ID NO: 48009 - DNA, 24 bp, Homo sapiens
caattattttgaggtgtctattgt

SEQ ID NO: 48010 - DNA, 25 bp, Homo sapiens
tgctgttgttccttctggaggcttc

SEQ ID NO: 48011 - DNA, 23 bp, Homo sapiens
accattggaatgctgagctgcgg

SEQ ID NO: 48012 - DNA, 24 bp, Homo sapiens
gatctgcaccccttgagtggctag

SEQ ID NO: 48013 - DNA, 25 bp, Homo sapiens
gacctgccagactcaagccatcttc

SEQ ID NO: 48014 - DNA, 25 bp, Homo sapiens
aggctggaatgtagtggcacaatca

SEQ ID NO: 48015 - DNA, 25 bp, Homo sapiens
gtgaactgctgcaacaacgtctgaa

SEQ ID NO: 48016 - DNA, 23 bp, Homo sapiens
cctggctgtgctgctggctgtag

SEQ ID NO: 48017 - DNA, 23 bp, Homo sapiens
gtgccgtgctcttcctgaaccac

SEQ ID NO: 48018 - DNA, 23 bp, Homo sapiens
cgccgtggtcactgtggaaaggg

SEQ ID NO: 48019 - DNA, 24 bp, Homo sapiens
actaaaatcatgtgagtataaaag

SEQ ID NO: 48020 - DNA, 24 bp, Homo sapiens
tactaaaatcatgtgagtataaaa

SEQ ID NO: 48021 - DNA, 24 bp, Homo sapiens
ttactaaaatcatgtgagtataaa

SEQ ID NO: 48022 - DNA, 24 bp, Homo sapiens
taaatatgaaggtaagtacaaaat

SEQ ID NO: 48023 - DNA, 24 bp, Homo sapiens
ttaaatatgaaggtaagtacaaaa

SEQ ID NO: 48024 - DNA, 24 bp, Homo sapiens
tttaaatatgaaggtaagtacaaa

SEQ ID NO: 48025 - DNA, 25 bp, Homo sapiens
tcattgtcaggctgcaagtgattct

SEQ ID NO: 48026 - DNA, 25 bp, Homo sapiens
ggcataaccaagcaactgtgttaca

SEQ ID NO: 48027 - DNA, 25 bp, Homo sapiens
gccacctatctactgcaagtctgat

SEQ ID NO: 48028 - DNA, 24 bp, Homo sapiens
tagtgacttttcatctgtatttga

SEQ ID NO: 48029 - DNA, 24 bp, Homo sapiens
atagtgacttttcatctgtatttg

SEQ ID NO: 48030 - DNA, 24 bp, Homo sapiens
aatagtgacttttcatctgtattt

SEQ ID NO: 48031 - DNA, 24 bp, Homo sapiens
ttttctctttaggaggttctttat

SEQ ID NO: 48032 - DNA, 24 bp, Homo sapiens
cttttctctttaggaggttcttta

SEQ ID NO: 48033 - DNA, 24 bp, Homo sapiens
tcttttctctttaggaggttcttt

SEQ ID NO: 48034 - DNA, 25 bp, Homo sapiens
agtctcactggtcttgaactcctgg

SEQ ID NO: 48035 - DNA, 25 bp, Homo sapiens
tgctgagagtgagagtgctaactac

SEQ ID NO: 48036 - DNA, 23 bp, Homo sapiens
attgcaggcatgagtcaccacgc

SEQ ID NO: 48037 - DNA, 24 bp, Homo sapiens
ttttcttgcagagtttgaattgat

SEQ ID NO: 48038 - DNA, 24 bp, Homo sapiens
tttttcttgcagagtttgaattga

SEQ ID NO: 48039 - DNA, 24 bp, Homo sapiens
ctttttcttgcagagtttgaattg

SEQ ID NO: 48040 - DNA, 23 bp, Homo sapiens
ccaccaggagcaacagccagacc

SEQ ID NO: 48041 - DNA, 23 bp, Homo sapiens
ccgttcaacctggagctgcttct

SEQ ID NO: 48042 - DNA, 23 bp, Homo sapiens
agacccagtgacttccaggctcc

SEQ ID NO: 48043 - DNA, 24 bp, Homo sapiens
tgcaggatgagatgcgtctgatgg

SEQ ID NO: 48044 - DNA, 24 bp, Homo sapiens
atgcaggatgagatgcgtctgatg

SEQ ID NO: 48045 - DNA, 24 bp, Homo sapiens
aatgcaggatgagatgcgtctgat

SEQ ID NO: 48046 - DNA, 24 bp, Homo sapiens
gaaaaatcaaggtaaaacaaaagt

SEQ ID NO: 48047 - DNA, 24 bp, Homo sapiens
agaaaaatcaaggtaaaacaaaag

SEQ ID NO: 48048 - DNA, 24 bp, Homo sapiens
aagaaaaatcaaggtaaaacaaaa

SEQ ID NO: 48049 - DNA, 23 bp, Homo sapiens
cccgttgcagcctttggaggagg

SEQ ID NO: 48050 - DNA, 23 bp, Homo sapiens
gacccagggcagggcacattatg

SEQ ID NO: 48051 - DNA, 24 bp, Homo sapiens
gccaccctgacatcaacaaccctt

SEQ ID NO: 48052 - DNA, 23 bp, Homo sapiens
tcctccaacgagatgcccgcctg

SEQ ID NO: 48053 - DNA, 23 bp, Homo sapiens
ctgacagaggaggagcaggaggc

SEQ ID NO: 48054 - DNA, 24 bp, Homo sapiens
ctgagactgaaggactgttggacc

SEQ ID NO: 48055 - DNA, 23 bp, Homo sapiens
gaccttgtccgagcgtctatgcg

SEQ ID NO: 48056 - DNA, 23 bp, Homo sapiens
ggaggctgaggctgctgtgaaag

SEQ ID NO: 48057 - DNA, 23 bp, Homo sapiens
ctcaggagaggctcagggagact

SEQ ID NO: 48058 - DNA, 25 bp, Homo sapiens
acataatccttggtgccactgttga

SEQ ID NO: 48059 - DNA, 25 bp, Homo sapiens
gttgactcctaagccagagacttca

SEQ ID NO: 48060 - DNA, 25 bp, Homo sapiens
cacaagtgttcccgaagagttccat

SEQ ID NO: 48061 - DNA, 24 bp, Homo sapiens
agtcacgcaatgttctggtcctgg

SEQ ID NO: 48062 - DNA, 24 bp, Homo sapiens
gctagtcttgaactcctgggctcg

SEQ ID NO: 48063 - DNA, 25 bp, Homo sapiens
tctgaacatctgattctgtatcttc

SEQ ID NO: 48064 - DNA, 23 bp, Homo sapiens
gggaggcaggcaccacaataagc

SEQ ID NO: 48065 - DNA, 25 bp, Homo sapiens
gcacctatggaaggagccaggatat

SEQ ID NO: 48066 - DNA, 23 bp, Homo sapiens
gaggcggcgtggctgagtgtttc

SEQ ID NO: 48067 - DNA, 24 bp, Homo sapiens
cagcagcaacagcagccaggactc

SEQ ID NO: 48068 - DNA, 24 bp, Homo sapiens
cgcaagggcatcaagtcgtccatt

SEQ ID NO: 48069 - DNA, 24 bp, Homo sapiens
ttgggaagaaggagaagggcaggc

SEQ ID NO: 48070 - DNA, 24 bp, Homo sapiens
cagcagcaacagcagccaggactc

SEQ ID NO: 48071 - DNA, 24 bp, Homo sapiens
attggccgcctgtttgggaagaag

SEQ ID NO: 48072 - DNA, 24 bp, Homo sapiens
ggcaggctgatccagctgagtcgg

SEQ ID NO: 48073 - DNA, 23 bp, Homo sapiens
atgtccagccgagaagaacttgc

SEQ ID NO: 48074 - DNA, 23 bp, Homo sapiens
agaaggacgcctgtggtgaggag

SEQ ID NO: 48075 - DNA, 23 bp, Homo sapiens
catcactgaccctgccgcccaag

SEQ ID NO: 48076 - DNA, 23 bp, Homo sapiens
cctgacctcggactgtggctggg

SEQ ID NO: 48077 - DNA, 23 bp, Homo sapiens
cggcagattgtgtcctggttcgc

SEQ ID NO: 48078 - DNA, 23 bp, Homo sapiens
gctcaggcaagaaggcaggtgac

SEQ ID NO: 48079 - DNA, 24 bp, Homo sapiens
tgggagaccggagtcaagaaattg

SEQ ID NO: 48080 - DNA, 24 bp, Homo sapiens
ctgggagaccggagtcaagaaatt

SEQ ID NO: 48081 - DNA, 24 bp, Homo sapiens
actgggagaccggagtcaagaaat

SEQ ID NO: 48082 - DNA, 24 bp, Homo sapiens
gtcagaaagaggaaaagaaaatta

SEQ ID NO: 48083 - DNA, 24 bp, Homo sapiens
agtcagaaagaggaaaagaaaatt

SEQ ID NO: 48084 - DNA, 24 bp, Homo sapiens
aagtcagaaagaggaaaagaaaat

SEQ ID NO: 48085 - DNA, 24 bp, Homo sapiens
gccaagaccatagtcctctcctgc

SEQ ID NO: 48086 - DNA, 25 bp, Homo sapiens
gatcggacgagacttctgttgtaat

SEQ ID NO: 48087 - DNA, 23 bp, Homo sapiens
gcccagccccagcccaggcaggc

SEQ ID NO: 48088 - DNA, 25 bp, Homo sapiens
gctgtatcttgtcctccgcttgtga

SEQ ID NO: 48089 - DNA, 25 bp, Homo sapiens
ttagagttagaccaatgcgaggagc

SEQ ID NO: 48090 - DNA, 24 bp, Homo sapiens
ggattctaactgctgctactctgt

SEQ ID NO: 48091 - DNA, 23 bp, Homo sapiens
cagtggcacgatcttggctcgct

SEQ ID NO: 48092 - DNA, 25 bp, Homo sapiens
tctgcctcccaggttcaagtgattc

SEQ ID NO: 48093 - DNA, 25 bp, Homo sapiens
ttcttaaaaaacataaagctctaaa

SEQ ID NO: 48094 - DNA, 25 bp, Homo sapiens
cggaagctggaaccttgttatctgg

SEQ ID NO: 48095 - DNA, 23 bp, Homo sapiens
ctcacaggggctctcactgctgg

SEQ ID NO: 48096 - DNA, 23 bp, Homo sapiens
ctgccctcccttccccctcagca

SEQ ID NO: 48097 - DNA, 24 bp, Homo sapiens
aacttcaaagagtatgtatattaa

SEQ ID NO: 48098 - DNA, 24 bp, Homo sapiens
gaacttcaaagagtatgtatatta

SEQ ID NO: 48099 - DNA, 24 bp, Homo sapiens
agaacttcaaagagtatgtatatt

SEQ ID NO: 48100 - DNA, 24 bp, Homo sapiens
cttcatcatgggtatggtattaac

SEQ ID NO: 48101 - DNA, 24 bp, Homo sapiens
acttcatcatgggtatggtattaa

SEQ ID NO: 48102 - DNA, 24 bp, Homo sapiens
cacttcatcatgggtatggtatta

SEQ ID NO: 48103 - DNA, 23 bp, Homo sapiens
cgaggtgctcacggagactctga

SEQ ID NO: 48104 - DNA, 23 bp, Homo sapiens
cacaccaccacgcccaacgaaat

SEQ ID NO: 48105 - DNA, 23 bp, Homo sapiens
aactcctgggctcaagcagtcct

SEQ ID NO: 48106 - DNA, 23 bp, Homo sapiens
gcttatcaccttccactgcctgc

SEQ ID NO: 48107 - DNA, 25 bp, Homo sapiens
ctgttacaaggattgaggtcgccat

SEQ ID NO: 48108 - DNA, 23 bp, Homo sapiens
atctcctgacctcgtgatccgcc

SEQ ID NO: 48109 - DNA, 24 bp, Homo sapiens
ccattggttccttcgtgctcagcg

SEQ ID NO: 48110 - DNA, 24 bp, Homo sapiens
agcaccaacaccacccaggatgag

SEQ ID NO: 48111 - DNA, 24 bp, Homo sapiens
aacgagggcttctattccagcacg

SEQ ID NO: 48112 - DNA, 23 bp, Homo sapiens
ggtggctaaggaagggaggaggg

SEQ ID NO: 48113 - DNA, 23 bp, Homo sapiens
ttacaggagcaggacccagcacc

SEQ ID NO: 48114 - DNA, 25 bp, Homo sapiens
agaagagctgaaggtctcgaactga

SEQ ID NO: 48115 - DNA, 24 bp, Homo sapiens
gttcttttcagcttcaacattgct

SEQ ID NO: 48116 - DNA, 24 bp, Homo sapiens
tgttcttttcagcttcaacattgc

SEQ ID NO: 48117 - DNA, 24 bp, Homo sapiens
ttgttcttttcagcttcaacattg

SEQ ID NO: 48118 - DNA, 24 bp, Homo sapiens
cttcgtcacaggcaccggcatggc

SEQ ID NO: 48119 - DNA, 24 bp, Homo sapiens
ccttcgtcacaggcaccggcatgg

SEQ ID NO: 48120 - DNA, 24 bp, Homo sapiens
accttcgtcacaggcaccggcatg

SEQ ID NO: 48121 - DNA, 24 bp, Homo sapiens
atttcgttatgctttcaatgtcat

SEQ ID NO: 48122 - DNA, 24 bp, Homo sapiens
gatttcgttatgctttcaatgtca

SEQ ID NO: 48123 - DNA, 24 bp, Homo sapiens
tgatttcgttatgctttcaatgtc

SEQ ID NO: 48124 - DNA, 24 bp, Homo sapiens
tatatattcaggtaaaatataatt

SEQ ID NO: 48125 - DNA, 24 bp, Homo sapiens
ctatatattcaggtaaaatataat

SEQ ID NO: 48126 - DNA, 24 bp, Homo sapiens
actatatattcaggtaaaatataa

SEQ ID NO: 48127 - DNA, 23 bp, Homo sapiens
aatgtggtggtggctgatgaggc

SEQ ID NO: 48128 - DNA, 25 bp, Homo sapiens
gctcctgaacaagacggtcaagaga

SEQ ID NO: 48129 - DNA, 25 bp, Homo sapiens
agaggagcggtctgttacatcttcc

SEQ ID NO: 48130 - DNA, 25 bp, Homo sapiens
agtgaatgtggtggtggctgatgag

SEQ ID NO: 48131 - DNA, 23 bp, Homo sapiens
gcccttgtgcttcaaggagcacc

SEQ ID NO: 48132 - DNA, 24 bp, Homo sapiens
tgaaggagcaggagcttcagtttc

SEQ ID NO: 48133 - DNA, 24 bp, Homo sapiens
gtgaaggagcaggagcttcagttt

SEQ ID NO: 48134 - DNA, 24 bp, Homo sapiens
cgtgaaggagcaggagcttcagtt

SEQ ID NO: 48135 - DNA, 24 bp, Homo sapiens
gacggctacagcatcaacagctgt

SEQ ID NO: 48136 - DNA, 24 bp, Homo sapiens
agacggctacagcatcaacagctg

SEQ ID NO: 48137 - DNA, 24 bp, Homo sapiens
tagacggctacagcatcaacagct

SEQ ID NO: 48138 - DNA, 24 bp, Homo sapiens
ccgagaccacagccaccactattc

SEQ ID NO: 48139 - DNA, 23 bp, Homo sapiens
ccgccaggaagctgcctccactg

SEQ ID NO: 48140 - DNA, 23 bp, Homo sapiens
ctcattggtggaggaggggcaac

SEQ ID NO: 48141 - DNA, 24 bp, Homo sapiens
ttcatttttaggctgaaaaagctt

SEQ ID NO: 48142 - DNA, 24 bp, Homo sapiens
attcatttttaggctgaaaaagct

SEQ ID NO: 48143 - DNA, 24 bp, Homo sapiens
tattcatttttaggctgaaaaagc

SEQ ID NO: 48144 - DNA, 23 bp, Homo sapiens
tttcgggaagctagcaggaggcc

SEQ ID NO: 48145 - DNA, 23 bp, Homo sapiens
ccctgttgctcgggcgcacctgg

SEQ ID NO: 48146 - DNA, 23 bp, Homo sapiens
tcgcagccgcagccgcagccgcg

SEQ ID NO: 48147 - DNA, 24 bp, Homo sapiens
caacaccttgtgaactattttatc

SEQ ID NO: 48148 - DNA, 24 bp, Homo sapiens
tcaacaccttgtgaactattttat

SEQ ID NO: 48149 - DNA, 24 bp, Homo sapiens
atcaacaccttgtgaactatttta

SEQ ID NO: 48150 - DNA, 24 bp, Homo sapiens
gttttaggaagtgtttctcttaaa

SEQ ID NO: 48151 - DNA, 24 bp, Homo sapiens
ggttttaggaagtgtttctcttaa

SEQ ID NO: 48152 - DNA, 24 bp, Homo sapiens
aggttttaggaagtgtttctctta

SEQ ID NO: 48153 - DNA, 24 bp, Homo sapiens
caggcagcggcagagagggaatgg

SEQ ID NO: 48154 - DNA, 24 bp, Homo sapiens
ggttagtgaaatgaggctctccgc

SEQ ID NO: 48155 - DNA, 24 bp, Homo sapiens
cagttcagggtcccaccgtcctcg

SEQ ID NO: 48156 - DNA, 24 bp, Homo sapiens
ggttagtgaaatgaggctctccgc

SEQ ID NO: 48157 - DNA, 24 bp, Homo sapiens
caggcagcggcagagagggaatgg

SEQ ID NO: 48158 - DNA, 24 bp, Homo sapiens
agaaagcaggcgagtgtttacggc

SEQ ID NO: 48159 - DNA, 24 bp, Homo sapiens
ggcggcttggattctatgctgagg

SEQ ID NO: 48160 - DNA, 24 bp, Homo sapiens
gctgctcaaggtggatggtcaact

SEQ ID NO: 48161 - DNA, 24 bp, Homo sapiens
cactccaaccagacggcattccat

SEQ ID NO: 48162 - DNA, 24 bp, Homo sapiens
atggcattatgatcagcatcttta

SEQ ID NO: 48163 - DNA, 24 bp, Homo sapiens
aatggcattatgatcagcatcttt

SEQ ID NO: 48164 - DNA, 24 bp, Homo sapiens
caatggcattatgatcagcatctt

SEQ ID NO: 48165 - DNA, 23 bp, Homo sapiens
tcactcggaggttcaccacggaa

SEQ ID NO: 48166 - DNA, 25 bp, Homo sapiens
gcagtgtctgtcctaagaagagcca

SEQ ID NO: 48167 - DNA, 23 bp, Homo sapiens
aagacgcaggcacaggcagtacc

SEQ ID NO: 48168 - DNA, 24 bp, Homo sapiens
atttcacgggagaacagatggcat

SEQ ID NO: 48169 - DNA, 24 bp, Homo sapiens
cagatcctcactggcaccgagacg

SEQ ID NO: 48170 - DNA, 24 bp, Homo sapiens
tggcacacttaggagacctgaacc

SEQ ID NO: 48171 - DNA, 24 bp, Homo sapiens
caggatggtggtgtgtgaccttgg

SEQ ID NO: 48172 - DNA, 24 bp, Homo sapiens
ttggaatcgaacgcaacaacaagg

SEQ ID NO: 48173 - DNA, 24 bp, Homo sapiens
gctgtcggctagaccagataagca

SEQ ID NO: 48174 - DNA, 24 bp, Homo sapiens
cgcaggtggaaataagaggagtgt

SEQ ID NO: 48175 - DNA, 24 bp, Homo sapiens
aagaggaggaggttggaccattgg

SEQ ID NO: 48176 - DNA, 24 bp, Homo sapiens
ggaccaagtaccatcagtgacacc

SEQ ID NO: 48177 - DNA, 24 bp, Homo sapiens
aggaaactggtggagagactcggc

SEQ ID NO: 48178 - DNA, 24 bp, Homo sapiens
ctgaagaggcagaaggagcaggct

SEQ ID NO: 48179 - DNA, 24 bp, Homo sapiens
caggagagccagagtcgcttggag

SEQ ID NO: 48180 - DNA, 24 bp, Homo sapiens
cattgatggaaacagggtgttggt

SEQ ID NO: 48181 - DNA, 24 bp, Homo sapiens
tcattgatggaaacagggtgttgg

SEQ ID NO: 48182 - DNA, 24 bp, Homo sapiens
gtcattgatggaaacagggtgttg

SEQ ID NO: 48183 - DNA, 24 bp, Homo sapiens
ttcttttctagatgatgaggtacc

SEQ ID NO: 48184 - DNA, 24 bp, Homo sapiens
cttcttttctagatgatgaggtac

SEQ ID NO: 48185 - DNA, 24 bp, Homo sapiens
tcttcttttctagatgatgaggta

SEQ ID NO: 48186 - DNA, 24 bp, Homo sapiens
cagccacattcagtcgccacaaga

SEQ ID NO: 48187 - DNA, 24 bp, Homo sapiens
cagcaggcaggtctggatgatgag

SEQ ID NO: 48188 - DNA, 24 bp, Homo sapiens
gtgagtggcagtgagatgagtggc

SEQ ID NO: 48189 - DNA, 24 bp, Homo sapiens
agatatataagatttgagaagtat

SEQ ID NO: 48190 - DNA, 24 bp, Homo sapiens
cagatatataagatttgagaagta

SEQ ID NO: 48191 - DNA, 24 bp, Homo sapiens
tcagatatataagatttgagaagt

SEQ ID NO: 48192 - DNA, 24 bp, Homo sapiens
gtttctatcagaacgtgaaaaaaa

SEQ ID NO: 48193 - DNA, 24 bp, Homo sapiens
tgtttctatcagaacgtgaaaaaa

SEQ ID NO: 48194 - DNA, 24 bp, Homo sapiens
gtgtttctatcagaacgtgaaaaa

SEQ ID NO: 48195 - DNA, 24 bp, Homo sapiens
tgaagattaagggacaagaaaagt

SEQ ID NO: 48196 - DNA, 24 bp, Homo sapiens
atgaagattaagggacaagaaaag

SEQ ID NO: 48197 - DNA, 24 bp, Homo sapiens
catgaagattaagggacaagaaaa

SEQ ID NO: 48198 - DNA, 24 bp, Homo sapiens
gaaaacccaaggcggtttacttat

SEQ ID NO: 48199 - DNA, 24 bp, Homo sapiens
agaaaacccaaggcggtttactta

SEQ ID NO: 48200 - DNA, 24 bp, Homo sapiens
aagaaaacccaaggcggtttactt

SEQ ID NO: 48201 - DNA, 24 bp, Homo sapiens
tctctttctagtcaatcatatttg

SEQ ID NO: 48202 - DNA, 24 bp, Homo sapiens
gtctctttctagtcaatcatattt

SEQ ID NO: 48203 - DNA, 24 bp, Homo sapiens
tgtctctttctagtcaatcatatt

SEQ ID NO: 48204 - DNA, 24 bp, Homo sapiens
cagctgcagaggggtcatccctgc

SEQ ID NO: 48205 - DNA, 24 bp, Homo sapiens
tcagctgcagaggggtcatccctg

SEQ ID NO: 48206 - DNA, 24 bp, Homo sapiens
ctcagctgcagaggggtcatccct

SEQ ID NO: 48207 - DNA, 23 bp, Homo sapiens
cgtggacgtgaaggaggaatggc

SEQ ID NO: 48208 - DNA, 24 bp, Homo sapiens
cttcaagccagtgcctcttcccag

SEQ ID NO: 48209 - DNA, 23 bp, Homo sapiens
gggaccaccgaagccacgctccg

SEQ ID NO: 48210 - DNA, 24 bp, Homo sapiens
gcagcagcagcaccaggcagacct

SEQ ID NO: 48211 - DNA, 24 bp, Homo sapiens
gaacgggcccagcatgagctgctg

SEQ ID NO: 48212 - DNA, 23 bp, Homo sapiens
tccttacagtcctggtcgtcgcc

SEQ ID NO: 48213 - DNA, 23 bp, Homo sapiens
catcactgcgctggccgtccaag

SEQ ID NO: 48214 - DNA, 23 bp, Homo sapiens
ccaccatgccgcccccgccgccg

SEQ ID NO: 48215 - DNA, 23 bp, Homo sapiens
tccttacagtcctggtcgtcgcc

SEQ ID NO: 48216 - DNA, 23 bp, Homo sapiens
catcactgcgctggccgtccaag

SEQ ID NO: 48217 - DNA, 23 bp, Homo sapiens
gccccaccatgccgcccccgccg

SEQ ID NO: 48218 - DNA, 24 bp, Homo sapiens
ctgactttcagacctttttaactc

SEQ ID NO: 48219 - DNA, 24 bp, Homo sapiens
tctgactttcagacctttttaact

SEQ ID NO: 48220 - DNA, 24 bp, Homo sapiens
ttctgactttcagacctttttaac

SEQ ID NO: 48221 - DNA, 24 bp, Homo sapiens
gcagcgcggccgacggggctccgg

SEQ ID NO: 48222 - DNA, 24 bp, Homo sapiens
ggagcccccggagccgctgtcccc

SEQ ID NO: 48223 - DNA, 24 bp, Homo sapiens
atgcagctgagccgcgccgccgcc

SEQ ID NO: 48224 - DNA, 24 bp, Homo sapiens
cctcaaccacagcctccaggacgc

SEQ ID NO: 48225 - DNA, 24 bp, Homo sapiens
gcgagtttatgcccagaacctcat

SEQ ID NO: 48226 - DNA, 24 bp, Homo sapiens
gcatagcacggacaaggtggcacg

SEQ ID NO: 48227 - DNA, 23 bp, Homo sapiens
cccagacctccagcacctgagcc

SEQ ID NO: 48228 - DNA, 23 bp, Homo sapiens
gagcccagccctccagagccaga

SEQ ID NO: 48229 - DNA, 23 bp, Homo sapiens
gagcctacctgcaaagcctggag

SEQ ID NO: 48230 - DNA, 23 bp, Homo sapiens
tcctttccactccgcccaccctg

SEQ ID NO: 48231 - DNA, 25 bp, Homo sapiens
ctcaccattggttttctcttcaaga

SEQ ID NO: 48232 - DNA, 24 bp, Homo sapiens
aggaggtacctgcagtattaccgg

SEQ ID NO: 48233 - DNA, 23 bp, Homo sapiens
cgtggtgaggaggcggaggcatc

SEQ ID NO: 48234 - DNA, 23 bp, Homo sapiens
gttacgagtccatgtccgagccg

SEQ ID NO: 48235 - DNA, 23 bp, Homo sapiens
ctgccgctgatgagactgctgtg

SEQ ID NO: 48236 - DNA, 24 bp, Homo sapiens
gtgtccaggcacgagaggtcactg

SEQ ID NO: 48237 - DNA, 24 bp, Homo sapiens
ggtctcctcggaggtagaagtgct

SEQ ID NO: 48238 - DNA, 24 bp, Homo sapiens
tcgaggaggagctggaactgagca

SEQ ID NO: 48239 - DNA, 24 bp, Homo sapiens
cttcctcctgggtgtagtggaaat

SEQ ID NO: 48240 - DNA, 24 bp, Homo sapiens
tcttcctcctgggtgtagtggaaa

SEQ ID NO: 48241 - DNA, 24 bp, Homo sapiens
ctcttcctcctgggtgtagtggaa

SEQ ID NO: 48242 - DNA, 24 bp, Homo sapiens
caaaatttgaggagcacaactcac

SEQ ID NO: 48243 - DNA, 24 bp, Homo sapiens
gcaaaatttgaggagcacaactca

SEQ ID NO: 48244 - DNA, 24 bp, Homo sapiens
agcaaaatttgaggagcacaactc

SEQ ID NO: 48245 - DNA, 24 bp, Homo sapiens
caccgccgccgcctctcgcaatat

SEQ ID NO: 48246 - DNA, 24 bp, Homo sapiens
tcctctcctttcctgcttctgcga

SEQ ID NO: 48247 - DNA, 24 bp, Homo sapiens
gccccttccctggaagccgagcgg

SEQ ID NO: 48248 - DNA, 24 bp, Homo sapiens
ctttatttaagtgaggaagtagaa

SEQ ID NO: 48249 - DNA, 24 bp, Homo sapiens
tctttatttaagtgaggaagtaga

SEQ ID NO: 48250 - DNA, 24 bp, Homo sapiens
ttctttatttaagtgaggaagtag

SEQ ID NO: 48251 - DNA, 24 bp, Homo sapiens
aaaagaaaaagatttcagaaaact

SEQ ID NO: 48252 - DNA, 24 bp, Homo sapiens
gaaaagaaaaagatttcagaaaac

SEQ ID NO: 48253 - DNA, 24 bp, Homo sapiens
ggaaaagaaaaagatttcagaaaa

SEQ ID NO: 48254 - DNA, 24 bp, Homo sapiens
cacttcctgatgctttgcttccca

SEQ ID NO: 48255 - DNA, 25 bp, Homo sapiens
accaaaggaaatcaaaccgtcacaa

SEQ ID NO: 48256 - DNA, 25 bp, Homo sapiens
atgaggaagaaccaatagaacggct

SEQ ID NO: 48257 - DNA, 24 bp, Homo sapiens
gcccagcccaggcttcctgccggt

SEQ ID NO: 48258 - DNA, 24 bp, Homo sapiens
agcccagcccaggcttcctgccgg

SEQ ID NO: 48259 - DNA, 24 bp, Homo sapiens
gagcccagcccaggcttcctgccg

SEQ ID NO: 48260 - DNA, 24 bp, Homo sapiens
gctggtgcgcggacagcaaggcct

SEQ ID NO: 48261 - DNA, 24 bp, Homo sapiens
agctggtgcgcggacagcaaggcc

SEQ ID NO: 48262 - DNA, 24 bp, Homo sapiens
cagctggtgcgcggacagcaaggc

SEQ ID NO: 48263 - DNA, 24 bp, Homo sapiens
tgaatttctagaacacagtgatgt

SEQ ID NO: 48264 - DNA, 24 bp, Homo sapiens
ttgaatttctagaacacagtgatg

SEQ ID NO: 48265 - DNA, 24 bp, Homo sapiens
tttgaatttctagaacacagtgat

SEQ ID NO: 48266 - DNA, 24 bp, Homo sapiens
tttattctcagggaaatgtgtcat

SEQ ID NO: 48267 - DNA, 24 bp, Homo sapiens
ctttattctcagggaaatgtgtca

SEQ ID NO: 48268 - DNA, 24 bp, Homo sapiens
actttattctcagggaaatgtgtc

SEQ ID NO: 48269 - DNA, 25 bp, Homo sapiens
cggaatgaatggaccaatgacactg

SEQ ID NO: 48270 - DNA, 24 bp, Homo sapiens
ggaggttcttcgcctgatcttcaa

SEQ ID NO: 48271 - DNA, 25 bp, Homo sapiens
aggaagaaccaatgaaacgcaaacc

SEQ ID NO: 48272 - DNA, 23 bp, Homo sapiens
aaggagggtctgccgcatgtgat

SEQ ID NO: 48273 - DNA, 23 bp, Homo sapiens
ggagatggaggaggagctggtgc

SEQ ID NO: 48274 - DNA, 23 bp, Homo sapiens
ctctgagccaggtgacactcggg

SEQ ID NO: 48275 - DNA, 24 bp, Homo sapiens
tcggctgtgaatccatctggtcct

SEQ ID NO: 48276 - DNA, 24 bp, Homo sapiens
taccagctcctccttgtacctctg

SEQ ID NO: 48277 - DNA, 24 bp, Homo sapiens
ctaaaatgagttagggaggcttcc

SEQ ID NO: 48278 - DNA, 24 bp, Homo sapiens
agacactgaagacctatgtgaaaa

SEQ ID NO: 48279 - DNA, 24 bp, Homo sapiens
aagacactgaagacctatgtgaaa

SEQ ID NO: 48280 - DNA, 24 bp, Homo sapiens
caagacactgaagacctatgtgaa

SEQ ID NO: 48281 - DNA, 24 bp, Homo sapiens
taatattacagcaacaagctcaac

SEQ ID NO: 48282 - DNA, 24 bp, Homo sapiens
ttaatattacagcaacaagctcaa

SEQ ID NO: 48283 - DNA, 24 bp, Homo sapiens
tttaatattacagcaacaagctca

SEQ ID NO: 48284 - DNA, 25 bp, Homo sapiens
gccacttccaaacctgatatcttga

SEQ ID NO: 48285 - DNA, 23 bp, Homo sapiens
ttttacagaaattaatggaggaa

SEQ ID NO: 48286 - DNA, 24 bp, Homo sapiens
ttgtcttttaggtaaagaagttaa

SEQ ID NO: 48287 - DNA, 24 bp, Homo sapiens
tttgtcttttaggtaaagaagtta

SEQ ID NO: 48288 - DNA, 24 bp, Homo sapiens
atttgtcttttaggtaaagaagtt

SEQ ID NO: 48289 - DNA, 24 bp, Homo sapiens
tgcaaaaataggtatttcctactt

SEQ ID NO: 48290 - DNA, 24 bp, Homo sapiens
ttgcaaaaataggtatttcctact

SEQ ID NO: 48291 - DNA, 24 bp, Homo sapiens
tttgcaaaaataggtatttcctac

SEQ ID NO: 48292 - DNA, 24 bp, Homo sapiens
aatgattattggttgtgcattatg

SEQ ID NO: 48293 - DNA, 24 bp, Homo sapiens
caatgattattggttgtgcattat

SEQ ID NO: 48294 - DNA, 24 bp, Homo sapiens
gcaatgattattggttgtgcatta

SEQ ID NO: 48295 - DNA, 24 bp, Homo sapiens
agttcttgaagtctttagctaaag

SEQ ID NO: 48296 - DNA, 24 bp, Homo sapiens
cagttcttgaagtctttagctaaa

SEQ ID NO: 48297 - DNA, 24 bp, Homo sapiens
ccagttcttgaagtctttagctaa

SEQ ID NO: 48298 - DNA, 24 bp, Homo sapiens
gccacttgcacaatgttgaccagc

SEQ ID NO: 48299 - DNA, 23 bp, Homo sapiens
aagacctgtccgaagccgaggag

SEQ ID NO: 48300 - DNA, 25 bp, Homo sapiens
tgaacgagtggtggactgtaaggac

SEQ ID NO: 48301 - DNA, 23 bp, Homo sapiens
ttgctgctgcctgtgctgctgct

SEQ ID NO: 48302 - DNA, 25 bp, Homo sapiens
ccgagtcatcagtgccagaagagga

SEQ ID NO: 48303 - DNA, 25 bp, Homo sapiens
gcacagactcttgatattgagccct

SEQ ID NO: 48304 - DNA, 24 bp, Homo sapiens
gaatcagaaagggattacaacatg

SEQ ID NO: 48305 - DNA, 24 bp, Homo sapiens
ggaatcagaaagggattacaacat

SEQ ID NO: 48306 - DNA, 24 bp, Homo sapiens
gggaatcagaaagggattacaaca

SEQ ID NO: 48307 - DNA, 25 bp, Homo sapiens
acagacggctttaaggaatcagagt

SEQ ID NO: 48308 - DNA, 23 bp, Homo sapiens
caaggctttgactggaatggcat

SEQ ID NO: 48309 - DNA, 25 bp, Homo sapiens
cacccagtggattcttcttgcccag

SEQ ID NO: 48310 - DNA, 25 bp, Homo sapiens
gaagaaggtgcggatggacaaggag

SEQ ID NO: 48311 - DNA, 23 bp, Homo sapiens
agatcacgctgctgctccgcctg

SEQ ID NO: 48312 - DNA, 25 bp, Homo sapiens
gaaccacctggagagcatcttcctg

SEQ ID NO: 48313 - DNA, 23 bp, Homo sapiens
ctcaccacgccaccacctccctc

SEQ ID NO: 48314 - DNA, 23 bp, Homo sapiens
cctctacgcctcgcttccggtcg

SEQ ID NO: 48315 - DNA, 24 bp, Homo sapiens
aatctttctgcctccacctcccga

SEQ ID NO: 48316 - DNA, 24 bp, Homo sapiens
gttgttggttccctgacgcccttc

SEQ ID NO: 48317 - DNA, 24 bp, Homo sapiens
agggttgttactggggtggtcacg

SEQ ID NO: 48318 - DNA, 24 bp, Homo sapiens
ggcggctgctgttggatcttagat

SEQ ID NO: 48319 - DNA, 24 bp, Homo sapiens
gcgataaagggaacattccacggg

SEQ ID NO: 48320 - DNA, 24 bp, Homo sapiens
tactcacactactaccagcagccc

SEQ ID NO: 48321 - DNA, 24 bp, Homo sapiens
tccccggccccgcaccggcccctg

SEQ ID NO: 48322 - DNA, 24 bp, Homo sapiens
gcggaccccaacgccgcgtgggcc

SEQ ID NO: 48323 - DNA, 24 bp, Homo sapiens
aaaaaatgcttagggaaatgcggg

SEQ ID NO: 48324 - DNA, 24 bp, Homo sapiens
caaaaaatgcttagggaaatgcgg

SEQ ID NO: 48325 - DNA, 24 bp, Homo sapiens
gcaaaaaatgcttagggaaatgcg

SEQ ID NO: 48326 - DNA, 24 bp, Homo sapiens
ataaagaacagaattaaatgtgag

SEQ ID NO: 48327 - DNA, 24 bp, Homo sapiens
tataaagaacagaattaaatgtga

SEQ ID NO: 48328 - DNA, 24 bp, Homo sapiens
atataaagaacagaattaaatgtg

SEQ ID NO: 48329 - DNA, 24 bp, Homo sapiens
aagatgtttatattggaaaccaca

SEQ ID NO: 48330 - DNA, 24 bp, Homo sapiens
gccctgaaaacctcaatggttact

SEQ ID NO: 48331 - DNA, 24 bp, Homo sapiens
atggaaaatgtgaattcatctatt

SEQ ID NO: 48332 - DNA, 24 bp, Homo sapiens
ctgggtgacagtctcacatcacga

SEQ ID NO: 48333 - DNA, 24 bp, Homo sapiens
cctgggtgacagtctcacatcacg

SEQ ID NO: 48334 - DNA, 24 bp, Homo sapiens
ccctgggtgacagtctcacatcac

SEQ ID NO: 48335 - DNA, 24 bp, Homo sapiens
ctaccgtgtccaggatgaagctgc

SEQ ID NO: 48336 - DNA, 23 bp, Homo sapiens
ccgatcagacctcaaggacaggc

SEQ ID NO: 48337 - DNA, 23 bp, Homo sapiens
cttgcctgctgtgcctgctgctg

SEQ ID NO: 48338 - DNA, 23 bp, Homo sapiens
cctgcctaatggttctgccttca

SEQ ID NO: 48339 - DNA, 25 bp, Homo sapiens
tgtgacagatgttatcattgctcca

SEQ ID NO: 48340 - DNA, 25 bp, Homo sapiens
gtaggacgatgcttctcttctgtca

SEQ ID NO: 48341 - DNA, 23 bp, Homo sapiens
atggagatgcggaagcggcagat

SEQ ID NO: 48342 - DNA, 24 bp, Homo sapiens
gcttctgctggtgctgctgttgta

SEQ ID NO: 48343 - DNA, 24 bp, Homo sapiens
actctggaagaagtcaacgcctgg

SEQ ID NO: 48344 - DNA, 24 bp, Homo sapiens
tctctgtgcaggctctgcgagagg

SEQ ID NO: 48345 - DNA, 24 bp, Homo sapiens
ttctctgtgcaggctctgcgagag

SEQ ID NO: 48346 - DNA, 24 bp, Homo sapiens
cttctctgtgcaggctctgcgaga

SEQ ID NO: 48347 - DNA, 24 bp, Homo sapiens
agccatcaacactcccttcccact

SEQ ID NO: 48348 - DNA, 24 bp, Homo sapiens
tgactactgccgccgccacaagat

SEQ ID NO: 48349 - DNA, 24 bp, Homo sapiens
tcaacatagatgcctgtggaggtg

SEQ ID NO: 48350 - DNA, 24 bp, Homo sapiens
tgtcttccttctccataggtccga

SEQ ID NO: 48351 - DNA, 24 bp, Homo sapiens
ctcaccacaacctccgcctcccag

SEQ ID NO: 48352 - DNA, 24 bp, Homo sapiens
tcctgagatccagacctccttacc

SEQ ID NO: 48353 - DNA, 24 bp, Homo sapiens
gggccgtgaagaggcagggcaggt

SEQ ID NO: 48354 - DNA, 24 bp, Homo sapiens
ggggccgtgaagaggcagggcagg

SEQ ID NO: 48355 - DNA, 24 bp, Homo sapiens
tggggccgtgaagaggcagggcag

SEQ ID NO: 48356 - DNA, 24 bp, Homo sapiens
gcaccatcaagccttaccaccgag

SEQ ID NO: 48357 - DNA, 23 bp, Homo sapiens
aatgacgctgtgctctgtgccgt

SEQ ID NO: 48358 - DNA, 25 bp, Homo sapiens
cggatctattacctgaagaagtcgc

SEQ ID NO: 48359 - DNA, 24 bp, Homo sapiens
ctggtggctgaacggcaagatgaa

SEQ ID NO: 48360 - DNA, 24 bp, Homo sapiens
ggtggtggcagcagtaggagtgtg

SEQ ID NO: 48361 - DNA, 24 bp, Homo sapiens
ggggtaatggggggtcagagtgcc

SEQ ID NO: 48362 - DNA, 23 bp, Homo sapiens
gcagtagcagcagccactctagg

SEQ ID NO: 48363 - DNA, 24 bp, Homo sapiens
ggtacagtgacgccgaggacttaa

SEQ ID NO: 48364 - DNA, 24 bp, Homo sapiens
actaaggcggtgtcaagaagcaga

SEQ ID NO: 48365 - DNA, 24 bp, Homo sapiens
actgctggtgctgctgctgttaat

SEQ ID NO: 48366 - DNA, 24 bp, Homo sapiens
ggtggcagcatggattctaggcag

SEQ ID NO: 48367 - DNA, 24 bp, Homo sapiens
ggaacagcaggtataagaggttgg

SEQ ID NO: 48368 - DNA, 24 bp, Homo sapiens
tggagctgtggctgtatccttggc

SEQ ID NO: 48369 - DNA, 24 bp, Homo sapiens
atggagctgtggctgtatccttgg

SEQ ID NO: 48370 - DNA, 24 bp, Homo sapiens
tatggagctgtggctgtatccttg

SEQ ID NO: 48371 - DNA, 25 bp, Homo sapiens
tctgactataatgaggcaacggagt

SEQ ID NO: 48372 - DNA, 25 bp, Homo sapiens
tcttacagggttgggttctaatgcc

SEQ ID NO: 48373 - DNA, 23 bp, Homo sapiens
ggcacggtggctcatacctataa

SEQ ID NO: 48374 - DNA, 25 bp, Homo sapiens
acaccaagcataggagccaaggaga

SEQ ID NO: 48375 - DNA, 24 bp, Homo sapiens
caactaaggctgctgaggctgctg

SEQ ID NO: 48376 - DNA, 23 bp, Homo sapiens
acgagcagcagaggcagcaagag

SEQ ID NO: 48377 - DNA, 23 bp, Homo sapiens
ccagcatccatgtctcgcagagc

SEQ ID NO: 48378 - DNA, 23 bp, Homo sapiens
agaccgacgccgccgacgccatc

SEQ ID NO: 48379 - DNA, 23 bp, Homo sapiens
ccagaccaccagcgtgtcgcagg

SEQ ID NO: 48380 - DNA, 24 bp, Homo sapiens
tgagccacctccaagacaagtatg

SEQ ID NO: 48381 - DNA, 24 bp, Homo sapiens
ctgtgactcgggctttgggaacct

SEQ ID NO: 48382 - DNA, 24 bp, Homo sapiens
cttgagagtgctggctgcgtgtct

SEQ ID NO: 48383 - DNA, 24 bp, Homo sapiens
gaaaagcaaagatcatagtttctt

SEQ ID NO: 48384 - DNA, 24 bp, Homo sapiens
agaaaagcaaagatcatagtttct

SEQ ID NO: 48385 - DNA, 24 bp, Homo sapiens
aagaaaagcaaagatcatagtttc

SEQ ID NO: 48386 - DNA, 24 bp, Homo sapiens
gataatcacagcgggactcttggc

SEQ ID NO: 48387 - DNA, 24 bp, Homo sapiens
cggagtggcagaagcgatggtgtg

SEQ ID NO: 48388 - DNA, 24 bp, Homo sapiens
tgagaagagcaagcagcccaaagg

SEQ ID NO: 48389 - DNA, 24 bp, Homo sapiens
ctgggtagaaggtaagttgtggac

SEQ ID NO: 48390 - DNA, 24 bp, Homo sapiens
tctgggtagaaggtaagttgtgga

SEQ ID NO: 48391 - DNA, 24 bp, Homo sapiens
ctctgggtagaaggtaagttgtgg

SEQ ID NO: 48392 - DNA, 23 bp, Homo sapiens
aggagatggactggctggtgctg

SEQ ID NO: 48393 - DNA, 25 bp, Homo sapiens
ctcagtgacacagaggactccttgc

SEQ ID NO: 48394 - DNA, 23 bp, Homo sapiens
cagagaccttcagtgccatcctg

SEQ ID NO: 48395 - DNA, 24 bp, Homo sapiens
tctccttgtttggaagcctttgca

SEQ ID NO: 48396 - DNA, 24 bp, Homo sapiens
ggacgtgcagcagccaccagcatt

SEQ ID NO: 48397 - DNA, 24 bp, Homo sapiens
gtaggagctttaaatcttggcaat

SEQ ID NO: 48398 - DNA, 25 bp, Homo sapiens
gcagccactgttacaattcaagatc

SEQ ID NO: 48399 - DNA, 25 bp, Homo sapiens
agcaatcctcagacgcctcacttag

SEQ ID NO: 48400 - DNA, 24 bp, Homo sapiens
tatatccatagattggaatattgg

SEQ ID NO: 48401 - DNA, 23 bp, Homo sapiens
gtgcagccactgttacaattcaa

SEQ ID NO: 48402 - DNA, 25 bp, Homo sapiens
gatctatatccatagattggaatat

SEQ ID NO: 48403 - DNA, 25 bp, Homo sapiens
agcatgactttcaaggatggttctt

SEQ ID NO: 48404 - DNA, 25 bp, Homo sapiens
ctgtgaaagtgttgggtcttcctcc

SEQ ID NO: 48405 - DNA, 24 bp, Homo sapiens
ctgggtgtgggttctgtgtccttc

SEQ ID NO: 48406 - DNA, 24 bp, Homo sapiens
aagataaactggtgaggaaattta

SEQ ID NO: 48407 - DNA, 24 bp, Homo sapiens
gaagataaactggtgaggaaattt

SEQ ID NO: 48408 - DNA, 24 bp, Homo sapiens
agaagataaactggtgaggaaatt

SEQ ID NO: 48409 - DNA, 25 bp, Homo sapiens
gcctcagtttcctcaccctatccct

SEQ ID NO: 48410 - DNA, 25 bp, Homo sapiens
ccaccgcacccagccttaaagttaa

SEQ ID NO: 48411 - DNA, 25 bp, Homo sapiens
cacacctaaacatttccaccttccc

SEQ ID NO: 48412 - DNA, 24 bp, Homo sapiens
gtgtatttcatgtaagtaattcta

SEQ ID NO: 48413 - DNA, 24 bp, Homo sapiens
tgtgtatttcatgtaagtaattct

SEQ ID NO: 48414 - DNA, 24 bp, Homo sapiens
gtgtgtatttcatgtaagtaattc

SEQ ID NO: 48415 - DNA, 24 bp, Homo sapiens
tgtctgatgaggtgttccatgaca

SEQ ID NO: 48416 - DNA, 24 bp, Homo sapiens
atgtctgatgaggtgttccatgac

SEQ ID NO: 48417 - DNA, 24 bp, Homo sapiens
gatgtctgatgaggtgttccatga

SEQ ID NO: 48418 - DNA, 24 bp, Homo sapiens
ttattctttaggtgttccatgaca

SEQ ID NO: 48419 - DNA, 24 bp, Homo sapiens
attattctttaggtgttccatgac

SEQ ID NO: 48420 - DNA, 24 bp, Homo sapiens
tattattctttaggtgttccatga

SEQ ID NO: 48421 - DNA, 24 bp, Homo sapiens
ttttaaactagtgttcagaatcaa

SEQ ID NO: 48422 - DNA, 24 bp, Homo sapiens
tttttaaactagtgttcagaatca

SEQ ID NO: 48423 - DNA, 24 bp, Homo sapiens
ttttttaaactagtgttcagaatc

SEQ ID NO: 48424 - DNA, 24 bp, Homo sapiens
ggacaaatcagataaaagccatca

SEQ ID NO: 48425 - DNA, 24 bp, Homo sapiens
aggacaaatcagataaaagccatc

SEQ ID NO: 48426 - DNA, 24 bp, Homo sapiens
caggacaaatcagataaaagccat

SEQ ID NO: 48427 - DNA, 24 bp, Homo sapiens
tggatgacagcagcgaagaggaac

SEQ ID NO: 48428 - DNA, 25 bp, Homo sapiens
cctaagtgggtggatggagtggatg

SEQ ID NO: 48429 - DNA, 23 bp, Homo sapiens
cagaagcagcgattggtgtgaca

SEQ ID NO: 48430 - DNA, 24 bp, Homo sapiens
aaatttcagaggtaggaagtgtag

SEQ ID NO: 48431 - DNA, 24 bp, Homo sapiens
gaaatttcagaggtaggaagtgta

SEQ ID NO: 48432 - DNA, 24 bp, Homo sapiens
tgaaatttcagaggtaggaagtgt

SEQ ID NO: 48433 - DNA, 24 bp, Homo sapiens
aagattgaagacacaggaggcagt

SEQ ID NO: 48434 - DNA, 24 bp, Homo sapiens
ttaactctgaggagcagtggacaa

SEQ ID NO: 48435 - DNA, 24 bp, Homo sapiens
ggtcttgcttgggtgtcctcacaa

SEQ ID NO: 48436 - DNA, 24 bp, Homo sapiens
aagttacacaggaacaatatgaat

SEQ ID NO: 48437 - DNA, 24 bp, Homo sapiens
aaagttacacaggaacaatatgaa

SEQ ID NO: 48438 - DNA, 24 bp, Homo sapiens
aaaagttacacaggaacaatatga

SEQ ID NO: 48439 - DNA, 24 bp, Homo sapiens
agactaggaagaactaaaattcca

SEQ ID NO: 48440 - DNA, 24 bp, Homo sapiens
aagactaggaagaactaaaattcc

SEQ ID NO: 48441 - DNA, 24 bp, Homo sapiens
aaagactaggaagaactaaaattc

SEQ ID NO: 48442 - DNA, 24 bp, Homo sapiens
cgaaatcaatggtaaagtacgatt

SEQ ID NO: 48443 - DNA, 24 bp, Homo sapiens
tcgaaatcaatggtaaagtacgat

SEQ ID NO: 48444 - DNA, 24 bp, Homo sapiens
ttcgaaatcaatggtaaagtacga

SEQ ID NO: 48445 - DNA, 24 bp, Homo sapiens
gtacaaattgacaatgccaagctg

SEQ ID NO: 48446 - DNA, 24 bp, Homo sapiens
tctctttgaagattttgttgagaa

SEQ ID NO: 48447 - DNA, 24 bp, Homo sapiens
ttctctttgaagattttgttgaga

SEQ ID NO: 48448 - DNA, 24 bp, Homo sapiens
attctctttgaagattttgttgag

SEQ ID NO: 48449 - DNA, 24 bp, Homo sapiens
aggactctcaggtacctatcactt

SEQ ID NO: 48450 - DNA, 24 bp, Homo sapiens
aaggactctcaggtacctatcact

SEQ ID NO: 48451 - DNA, 24 bp, Homo sapiens
aaaggactctcaggtacctatcac

SEQ ID NO: 48452 - DNA, 24 bp, Homo sapiens
gatttccacggctcttgcccagag

SEQ ID NO: 48453 - DNA, 23 bp, Homo sapiens
cactgtgttccaatgtgccacgg

SEQ ID NO: 48454 - DNA, 23 bp, Homo sapiens
catgaaggaagaggcaggccacg

SEQ ID NO: 48455 - DNA, 24 bp, Homo sapiens
attgctaccagggtgcgcctggct

SEQ ID NO: 48456 - DNA, 24 bp, Homo sapiens
cattgctaccagggtgcgcctggc

SEQ ID NO: 48457 - DNA, 24 bp, Homo sapiens
acattgctaccagggtgcgcctgg

SEQ ID NO: 48458 - DNA, 24 bp, Homo sapiens
aggatgttgcggaggctgctggag

SEQ ID NO: 48459 - DNA, 24 bp, Homo sapiens
ccgaagtctcagtgccctatttgg

SEQ ID NO: 48460 - DNA, 24 bp, Homo sapiens
cagggaccgacatttgactattct

SEQ ID NO: 48461 - DNA, 24 bp, Homo sapiens
cagtaacctcagtcacctgcctgg

SEQ ID NO: 48462 - DNA, 24 bp, Homo sapiens
ccgaagtctcagtgccctatttgg

SEQ ID NO: 48463 - DNA, 24 bp, Homo sapiens
aggatgttgcggaggctgctggag

SEQ ID NO: 48464 - DNA, 25 bp, Homo sapiens
tggagtacagtggcaggatctcagc

SEQ ID NO: 48465 - DNA, 25 bp, Homo sapiens
tctccgtctctcaggtttaagcagt

SEQ ID NO: 48466 - DNA, 23 bp, Homo sapiens
ggactacagaaccttcggctcgc

SEQ ID NO: 48467 - DNA, 23 bp, Homo sapiens
cgtggtgctctccgactactcac

SEQ ID NO: 48468 - DNA, 25 bp, Homo sapiens
tggagtacagtggcaggatctcagc

SEQ ID NO: 48469 - DNA, 23 bp, Homo sapiens
gcagagtagcgaggacttcagtt

SEQ ID NO: 48470 - DNA, 24 bp, Homo sapiens
tgttttcagagactaaaatgttcg

SEQ ID NO: 48471 - DNA, 24 bp, Homo sapiens
ctgttttcagagactaaaatgttc

SEQ ID NO: 48472 - DNA, 24 bp, Homo sapiens
tctgttttcagagactaaaatgtt

SEQ ID NO: 48473 - DNA, 25 bp, Homo sapiens
aggaagaaattgccaaaccatgtct

SEQ ID NO: 48474 - DNA, 25 bp, Homo sapiens
ccctgggctcaaatgatcctcctac

SEQ ID NO: 48475 - DNA, 23 bp, Homo sapiens
ttcagagtagttcacaacagatc

SEQ ID NO: 48476 - DNA, 24 bp, Homo sapiens
tgaaacacatggcaaaatcaagaa

SEQ ID NO: 48477 - DNA, 24 bp, Homo sapiens
atgaaacacatggcaaaatcaaga

SEQ ID NO: 48478 - DNA, 24 bp, Homo sapiens
aatgaaacacatggcaaaatcaag

SEQ ID NO: 48479 - DNA, 24 bp, Homo sapiens
cctcggcagtgacgctgacagatg

SEQ ID NO: 48480 - DNA, 24 bp, Homo sapiens
cttgccagccacccgtccagtcca

SEQ ID NO: 48481 - DNA, 24 bp, Homo sapiens
aatggtcgcaccttcaaagtgggc

SEQ ID NO: 48482 - DNA, 24 bp, Homo sapiens
ttctccaacagggttcttggtgat

SEQ ID NO: 48483 - DNA, 24 bp, Homo sapiens
cttctccaacagggttcttggtga

SEQ ID NO: 48484 - DNA, 24 bp, Homo sapiens
ccttctccaacagggttcttggtg

SEQ ID NO: 48485 - DNA, 23 bp, Homo sapiens
cttcctggtggctgggctgatgt

SEQ ID NO: 48486 - DNA, 25 bp, Homo sapiens
gctccatgatgcagtcgctgatctt

SEQ ID NO: 48487 - DNA, 25 bp, Homo sapiens
ttaccactacatctttgtgactggg

SEQ ID NO: 48488 - DNA, 23 bp, Homo sapiens
gcttcctggtggctgggctgatg

SEQ ID NO: 48489 - DNA, 23 bp, Homo sapiens
tgctccatgatgcagtcgctgat

SEQ ID NO: 48490 - DNA, 25 bp, Homo sapiens
gggtgaagtttcgtactgggatcat

SEQ ID NO: 48491 - DNA, 24 bp, Homo sapiens
ggctgaaacaggtgtaactattag

SEQ ID NO: 48492 - DNA, 24 bp, Homo sapiens
aggctgaaacaggtgtaactatta

SEQ ID NO: 48493 - DNA, 24 bp, Homo sapiens
caggctgaaacaggtgtaactatt

SEQ ID NO: 48494 - DNA, 24 bp, Homo sapiens
tatactcataagtttccagagatg

SEQ ID NO: 48495 - DNA, 24 bp, Homo sapiens
atatactcataagtttccagagat

SEQ ID NO: 48496 - DNA, 24 bp, Homo sapiens
aatatactcataagtttccagaga

SEQ ID NO: 48497 - DNA, 24 bp, Homo sapiens
tcctgccccacgccacccccgtcc

SEQ ID NO: 48498 - DNA, 24 bp, Homo sapiens
gtcctgccccacgccacccccgtc

SEQ ID NO: 48499 - DNA, 24 bp, Homo sapiens
tgtcctgccccacgccacccccgt

SEQ ID NO: 48500 - DNA, 24 bp, Homo sapiens
ctccccgtgtccaagaaaaccctg

SEQ ID NO: 48501 - DNA, 24 bp, Homo sapiens
cgtgctgctgcggaaggactgtgg

SEQ ID NO: 48502 - DNA, 24 bp, Homo sapiens
gagcccaagtcagccttcactcag

SEQ ID NO: 48503 - DNA, 24 bp, Homo sapiens
catgatccgcctgcctccacctcc

SEQ ID NO: 48504 - DNA, 24 bp, Homo sapiens
aaaccttaataaatgacacacttt

SEQ ID NO: 48505 - DNA, 24 bp, Homo sapiens
tggcccgagaccttctttcaaaaa

SEQ ID NO: 48506 - DNA, 23 bp, Homo sapiens
gcccctgccctggttccgttgcg

SEQ ID NO: 48507 - DNA, 23 bp, Homo sapiens
cccccgacccctcgcccccttcg

SEQ ID NO: 48508 - DNA, 23 bp, Homo sapiens
ccgtcatggaggcgcccaccgtg

SEQ ID NO: 48509 - DNA, 24 bp, Homo sapiens
atagtctcaaggtatgtgcaaaaa

SEQ ID NO: 48510 - DNA, 24 bp, Homo sapiens
aatagtctcaaggtatgtgcaaaa

SEQ ID NO: 48511 - DNA, 24 bp, Homo sapiens
aaatagtctcaaggtatgtgcaaa

SEQ ID NO: 48512 - DNA, 24 bp, Homo sapiens
attttcattaggttaccttgtatg

SEQ ID NO: 48513 - DNA, 24 bp, Homo sapiens
tattttcattaggttaccttgtat

SEQ ID NO: 48514 - DNA, 24 bp, Homo sapiens
ttattttcattaggttaccttgta

SEQ ID NO: 48515 - DNA, 24 bp, Homo sapiens
agcttgttgagacctgtcgattgt

SEQ ID NO: 48516 - DNA, 24 bp, Homo sapiens
cagcttgttgagacctgtcgattg

SEQ ID NO: 48517 - DNA, 24 bp, Homo sapiens
gcagcttgttgagacctgtcgatt

SEQ ID NO: 48518 - DNA, 24 bp, Homo sapiens
cgaggaattagatgaaaagggaag

SEQ ID NO: 48519 - DNA, 24 bp, Homo sapiens
ccgaggaattagatgaaaagggaa

SEQ ID NO: 48520 - DNA, 24 bp, Homo sapiens
gccgaggaattagatgaaaaggga

SEQ ID NO: 48521 - DNA, 24 bp, Homo sapiens
tccaaatggagatgtacatcaaaa

SEQ ID NO: 48522 - DNA, 24 bp, Homo sapiens
ttccaaatggagatgtacatcaaa

SEQ ID NO: 48523 - DNA, 24 bp, Homo sapiens
gttccaaatggagatgtacatcaa

SEQ ID NO: 48524 - DNA, 24 bp, Homo sapiens
agcctactggaaaatacaaacctg

SEQ ID NO: 48525 - DNA, 24 bp, Homo sapiens
cagcctactggaaaatacaaacct

SEQ ID NO: 48526 - DNA, 24 bp, Homo sapiens
tcagcctactggaaaatacaaacc

SEQ ID NO: 48527 - DNA, 24 bp, Homo sapiens
cacaaatcaaggtatgtttgttca

SEQ ID NO: 48528 - DNA, 24 bp, Homo sapiens
gcacaaatcaaggtatgtttgttc

SEQ ID NO: 48529 - DNA, 24 bp, Homo sapiens
tgcacaaatcaaggtatgtttgtt

SEQ ID NO: 48530 - DNA, 24 bp, Homo sapiens
gtggcacctctgctgatctcacag

SEQ ID NO: 48531 - DNA, 24 bp, Homo sapiens
gccctctatgtcctgccagtgctg

SEQ ID NO: 48532 - DNA, 24 bp, Homo sapiens
agaggctgaggctgtggtgctgac

SEQ ID NO: 48533 - DNA, 24 bp, Homo sapiens
acaaaaaagagaatgccattgaca

SEQ ID NO: 48534 - DNA, 24 bp, Homo sapiens
tacaaaaaagagaatgccattgac

SEQ ID NO: 48535 - DNA, 24 bp, Homo sapiens
atacaaaaaagagaatgccattga

SEQ ID NO: 48536 - DNA, 24 bp, Homo sapiens
tgaggaaaacagtaagaaaagaca

SEQ ID NO: 48537 - DNA, 24 bp, Homo sapiens
ctgaggaaaacagtaagaaaagac

SEQ ID NO: 48538 - DNA, 24 bp, Homo sapiens
cctgaggaaaacagtaagaaaaga

SEQ ID NO: 48539 - DNA, 24 bp, Homo sapiens
tgttctttcagatgtgattttgaa

SEQ ID NO: 48540 - DNA, 24 bp, Homo sapiens
ctgttctttcagatgtgattttga

SEQ ID NO: 48541 - DNA, 24 bp, Homo sapiens
tctgttctttcagatgtgattttg

SEQ ID NO: 48542 - DNA, 24 bp, Homo sapiens
ctgctgctgctgctgctgctcgct

SEQ ID NO: 48543 - DNA, 24 bp, Homo sapiens
atacgcctctgacgcttcactgga

SEQ ID NO: 48544 - DNA, 24 bp, Homo sapiens
gtcccgagctttcgcccgacgatc

SEQ ID NO: 48545 - DNA, 24 bp, Homo sapiens
gtgtgaatgagtatggtcttccaa

SEQ ID NO: 48546 - DNA, 24 bp, Homo sapiens
ggtgtgaatgagtatggtcttcca

SEQ ID NO: 48547 - DNA, 24 bp, Homo sapiens
tggtgtgaatgagtatggtcttcc

SEQ ID NO: 48548 - DNA, 24 bp, Homo sapiens
atcaaaatcaggtatgctgggcta

SEQ ID NO: 48549 - DNA, 24 bp, Homo sapiens
aatcaaaatcaggtatgctgggct

SEQ ID NO: 48550 - DNA, 24 bp, Homo sapiens
caatcaaaatcaggtatgctgggc

SEQ ID NO: 48551 - DNA, 24 bp, Homo sapiens
ctggggaacaaaggctgcagggtc

SEQ ID NO: 48552 - DNA, 24 bp, Homo sapiens
tctggggaacaaaggctgcagggt

SEQ ID NO: 48553 - DNA, 24 bp, Homo sapiens
atctggggaacaaaggctgcaggg

SEQ ID NO: 48554 - DNA, 24 bp, Homo sapiens
ttctgtttcagatatgtaataatt

SEQ ID NO: 48555 - DNA, 24 bp, Homo sapiens
tttctgtttcagatatgtaataat

SEQ ID NO: 48556 - DNA, 24 bp, Homo sapiens
ttttctgtttcagatatgtaataa

SEQ ID NO: 48557 - DNA, 24 bp, Homo sapiens
ctcggaaaacagtaagatatgatt

SEQ ID NO: 48558 - DNA, 24 bp, Homo sapiens
tctcggaaaacagtaagatatgat

SEQ ID NO: 48559 - DNA, 24 bp, Homo sapiens
atctcggaaaacagtaagatatga

SEQ ID NO: 48560 - DNA, 24 bp, Homo sapiens
acaaccttacactctacatctcgg

SEQ ID NO: 48561 - DNA, 24 bp, Homo sapiens
gccattaccaaggatatgctgccg

SEQ ID NO: 48562 - DNA, 24 bp, Homo sapiens
gcagaaagaccagccctacaaagt

SEQ ID NO: 48563 - DNA, 24 bp, Homo sapiens
atggaacagacaatgcctatgtgg

SEQ ID NO: 48564 - DNA, 24 bp, Homo sapiens
aacggaaggatgttctctgtggaa

SEQ ID NO: 48565 - DNA, 24 bp, Homo sapiens
aggtgctcaaggtgctccatttgc

SEQ ID NO: 48566 - DNA, 24 bp, Homo sapiens
ctgcggatgattgaggatgctgag

SEQ ID NO: 48567 - DNA, 24 bp, Homo sapiens
atcgtgatgccagagaagatgagc

SEQ ID NO: 48568 - DNA, 24 bp, Homo sapiens
cctggcggctgaagaacgaaatcc

SEQ ID NO: 48569 - DNA, 25 bp, Homo sapiens
ctgtgtccaagagactccaggctga

SEQ ID NO: 48570 - DNA, 23 bp, Homo sapiens
ctacccgccctctgcccgctgac

SEQ ID NO: 48571 - DNA, 23 bp, Homo sapiens
ccccccttccaggccgctgccgc

SEQ ID NO: 48572 - DNA, 24 bp, Homo sapiens
tttctatttagagcttgaagttgg

SEQ ID NO: 48573 - DNA, 24 bp, Homo sapiens
gtttctatttagagcttgaagttg

SEQ ID NO: 48574 - DNA, 24 bp, Homo sapiens
tgtttctatttagagcttgaagtt

SEQ ID NO: 48575 - DNA, 24 bp, Homo sapiens
aatggtctaaggtaatgcagaata

SEQ ID NO: 48576 - DNA, 24 bp, Homo sapiens
taatggtctaaggtaatgcagaat

SEQ ID NO: 48577 - DNA, 24 bp, Homo sapiens
gtaatggtctaaggtaatgcagaa

SEQ ID NO: 48578 - DNA, 24 bp, Homo sapiens
tcgcagaaatggtcatcctcacaa

SEQ ID NO: 48579 - DNA, 24 bp, Homo sapiens
catgtgacgttggttggcattgaa

SEQ ID NO: 48580 - DNA, 24 bp, Homo sapiens
ctcagtgggaagtggctctactca

SEQ ID NO: 48581 - DNA, 24 bp, Homo sapiens
gccctccccccgccccgagccccg

SEQ ID NO: 48582 - DNA, 24 bp, Homo sapiens
tgccctccccccgccccgagcccc

SEQ ID NO: 48583 - DNA, 24 bp, Homo sapiens
gtgccctccccccgccccgagccc

SEQ ID NO: 48584 - DNA, 24 bp, Homo sapiens
gtgtgacccagccatgggcctgcg

SEQ ID NO: 48585 - DNA, 24 bp, Homo sapiens
tgtgtgacccagccatgggcctgc

SEQ ID NO: 48586 - DNA, 24 bp, Homo sapiens
atgtgtgacccagccatgggcctg

SEQ ID NO: 48587 - DNA, 24 bp, Homo sapiens
tcctctgctggagttcatcctgct

SEQ ID NO: 48588 - DNA, 24 bp, Homo sapiens
cgtcttgaggctggtgctgtatct

SEQ ID NO: 48589 - DNA, 24 bp, Homo sapiens
gcagtccaggttatcgtgtgaagg

SEQ ID NO: 48590 - DNA, 24 bp, Homo sapiens
tcctctgctggagttcatcctgct

SEQ ID NO: 48591 - DNA, 24 bp, Homo sapiens
cgtcttgaggctggtgctgtatct

SEQ ID NO: 48592 - DNA, 24 bp, Homo sapiens
gcaaggaggacgagtacccagtgg

SEQ ID NO: 48593 - DNA, 24 bp, Homo sapiens
gtattttgtaggaaaagctcaaga

SEQ ID NO: 48594 - DNA, 24 bp, Homo sapiens
tgtattttgtaggaaaagctcaag

SEQ ID NO: 48595 - DNA, 24 bp, Homo sapiens
ttgtattttgtaggaaaagctcaa

SEQ ID NO: 48596 - DNA, 23 bp, Homo sapiens
gcctccaggaagcagagcgtcat

SEQ ID NO: 48597 - DNA, 23 bp, Homo sapiens
ctgtcgctgctgtgcctggtgtt

SEQ ID NO: 48598 - DNA, 23 bp, Homo sapiens
cgccactacacgcagttctggaa

SEQ ID NO: 48599 - DNA, 23 bp, Homo sapiens
ctgtcgctgctgtgcctggtgtt

SEQ ID NO: 48600 - DNA, 23 bp, Homo sapiens
cgccactacacgcagttctggaa

SEQ ID NO: 48601 - DNA, 23 bp, Homo sapiens
ctgccgctactgcaacgtcctct

SEQ ID NO: 48602 - DNA, 23 bp, Homo sapiens
ctgtcgctgctgtgcctggtgtt

SEQ ID NO: 48603 - DNA, 23 bp, Homo sapiens
cgccactacacgcagttctggaa

SEQ ID NO: 48604 - DNA, 23 bp, Homo sapiens
acaaccgtgcctgccgctgccgc

SEQ ID NO: 48605 - DNA, 23 bp, Homo sapiens
acaaccgtgcctgccgctgccgc

SEQ ID NO: 48606 - DNA, 23 bp, Homo sapiens
cgccactacacgcagttctggaa

SEQ ID NO: 48607 - DNA, 23 bp, Homo sapiens
ggcagaaacacccacctacccct

SEQ ID NO: 48608 - DNA, 24 bp, Homo sapiens
catgctgccaagagatgcagaaac

SEQ ID NO: 48609 - DNA, 24 bp, Homo sapiens
tcatgctgccaagagatgcagaaa

SEQ ID NO: 48610 - DNA, 24 bp, Homo sapiens
ttcatgctgccaagagatgcagaa

SEQ ID NO: 48611 - DNA, 24 bp, Homo sapiens
taaagccattggtaagtttagtgt

SEQ ID NO: 48612 - DNA, 24 bp, Homo sapiens
ttaaagccattggtaagtttagtg

SEQ ID NO: 48613 - DNA, 24 bp, Homo sapiens
attaaagccattggtaagtttagt

SEQ ID NO: 48614 - DNA, 24 bp, Homo sapiens
ataccaacaaggtatattcttaat

SEQ ID NO: 48615 - DNA, 24 bp, Homo sapiens
gataccaacaaggtatattcttaa

SEQ ID NO: 48616 - DNA, 24 bp, Homo sapiens
tgataccaacaaggtatattctta

SEQ ID NO: 48617 - DNA, 24 bp, Homo sapiens
taacagaaaaggtatcagatttgc

SEQ ID NO: 48618 - DNA, 24 bp, Homo sapiens
ctaacagaaaaggtatcagatttg

SEQ ID NO: 48619 - DNA, 24 bp, Homo sapiens
gctaacagaaaaggtatcagattt

SEQ ID NO: 48620 - DNA, 24 bp, Homo sapiens
cctgacataaagtaagtatcattt

SEQ ID NO: 48621 - DNA, 24 bp, Homo sapiens
ccctgacataaagtaagtatcatt

SEQ ID NO: 48622 - DNA, 24 bp, Homo sapiens
gccctgacataaagtaagtatcat

SEQ ID NO: 48623 - DNA, 24 bp, Homo sapiens
tatttttgtagatagaagctttgg

SEQ ID NO: 48624 - DNA, 24 bp, Homo sapiens
ttatttttgtagatagaagctttg

SEQ ID NO: 48625 - DNA, 24 bp, Homo sapiens
attatttttgtagatagaagcttt

SEQ ID NO: 48626 - DNA, 24 bp, Homo sapiens
aatgccaaattggtggaaatccca

SEQ ID NO: 48627 - DNA, 24 bp, Homo sapiens
aaatgccaaattggtggaaatccc

SEQ ID NO: 48628 - DNA, 24 bp, Homo sapiens
taaatgccaaattggtggaaatcc

SEQ ID NO: 48629 - DNA, 24 bp, Homo sapiens
gagtggaggcagtagacatggaga

SEQ ID NO: 48630 - DNA, 24 bp, Homo sapiens
agtggtaaattacgctccttcgct

SEQ ID NO: 48631 - DNA, 24 bp, Homo sapiens
ctcaaactcctgggctcaagcgat

SEQ ID NO: 48632 - DNA, 24 bp, Homo sapiens
caatgtccaccgccaccaccaacc

SEQ ID NO: 48633 - DNA, 24 bp, Homo sapiens
tccagcatacgacctgtgactcct

SEQ ID NO: 48634 - DNA, 24 bp, Homo sapiens
cttcttcttcctacccctccagcc

SEQ ID NO: 48635 - DNA, 24 bp, Homo sapiens
tgctctgactgcctggacaggacc

SEQ ID NO: 48636 - DNA, 24 bp, Homo sapiens
gtgctctgactgcctggacaggac

SEQ ID NO: 48637 - DNA, 24 bp, Homo sapiens
cgtgctctgactgcctggacagga

SEQ ID NO: 48638 - DNA, 24 bp, Homo sapiens
aatgagaaaggaagacaaaatctc

SEQ ID NO: 48639 - DNA, 24 bp, Homo sapiens
aaatgagaaaggaagacaaaatct

SEQ ID NO: 48640 - DNA, 24 bp, Homo sapiens
aaaatgagaaaggaagacaaaatc

SEQ ID NO: 48641 - DNA, 24 bp, Homo sapiens
aataccactgggtaaaaataatta

SEQ ID NO: 48642 - DNA, 24 bp, Homo sapiens
aaataccactgggtaaaaataatt

SEQ ID NO: 48643 - DNA, 24 bp, Homo sapiens
aaaataccactgggtaaaaataat

SEQ ID NO: 48644 - DNA, 24 bp, Homo sapiens
tttctttgcagagatgaaaattac

SEQ ID NO: 48645 - DNA, 24 bp, Homo sapiens
ctttctttgcagagatgaaaatta

SEQ ID NO: 48646 - DNA, 24 bp, Homo sapiens
tctttctttgcagagatgaaaatt

SEQ ID NO: 48647 - DNA, 24 bp, Homo sapiens
aagaagaagaggcagtcctggttt

SEQ ID NO: 48648 - DNA, 24 bp, Homo sapiens
aaagaagaagaggcagtcctggtt

SEQ ID NO: 48649 - DNA, 24 bp, Homo sapiens
taaagaagaagaggcagtcctggt

SEQ ID NO: 48650 - DNA, 24 bp, Homo sapiens
aagcaggcaggaccacaggatact

SEQ ID NO: 48651 - DNA, 25 bp, Homo sapiens
tcaacttctgataggtctgtcattg

SEQ ID NO: 48652 - DNA, 25 bp, Homo sapiens
aatttgctgccattctacttgcttt

SEQ ID NO: 48653 - DNA, 25 bp, Homo sapiens
tcagaaacaatcagagccaagactt

SEQ ID NO: 48654 - DNA, 24 bp, Homo sapiens
aacactaatcgagaccagaacctg

SEQ ID NO: 48655 - DNA, 24 bp, Homo sapiens
aagcaggcaggaccacaggatact

SEQ ID NO: 48656 - DNA, 24 bp, Homo sapiens
tccgcttcagtgctcagagccaag

SEQ ID NO: 48657 - DNA, 24 bp, Homo sapiens
cctgggctgcggctgtcatggacg

SEQ ID NO: 48658 - DNA, 24 bp, Homo sapiens
ttccttgatgttggtggtggtgct

SEQ ID NO: 48659 - DNA, 24 bp, Homo sapiens
aaatggtgctggtttggctatggc

SEQ ID NO: 48660 - DNA, 24 bp, Homo sapiens
aagggacaaagatgctgctaaggc

SEQ ID NO: 48661 - DNA, 24 bp, Homo sapiens
atgagaattatgtatgtatgtgta

SEQ ID NO: 48662 - DNA, 24 bp, Homo sapiens
aatgagaattatgtatgtatgtgt

SEQ ID NO: 48663 - DNA, 24 bp, Homo sapiens
aaatgagaattatgtatgtatgtg

SEQ ID NO: 48664 - DNA, 24 bp, Homo sapiens
aggaaaacaagctcagggctccac

SEQ ID NO: 48665 - DNA, 24 bp, Homo sapiens
gggctgaagacagcctggcggtat

SEQ ID NO: 48666 - DNA, 24 bp, Homo sapiens
agggctgaagacagcctggcggta

SEQ ID NO: 48667 - DNA, 24 bp, Homo sapiens
cagggctgaagacagcctggcggt

SEQ ID NO: 48668 - DNA, 24 bp, Homo sapiens
tctcacaccatccaaaatttattc

SEQ ID NO: 48669 - DNA, 24 bp, Homo sapiens
ctctcacaccatccaaaatttatt

SEQ ID NO: 48670 - DNA, 24 bp, Homo sapiens
tctctcacaccatccaaaatttat

SEQ ID NO: 48671 - DNA, 24 bp, Homo sapiens
ggttcttggtctcactgacttcaa

SEQ ID NO: 48672 - DNA, 24 bp, Homo sapiens
ctgaaatgaaagggagtgtgagcc

SEQ ID NO: 48673 - DNA, 24 bp, Homo sapiens
gcttggagtgccctcagttctaag

SEQ ID NO: 48674 - DNA, 24 bp, Homo sapiens
ggaggagcaggcacatcacatgag

SEQ ID NO: 48675 - DNA, 24 bp, Homo sapiens
cgaacgcaggaaagtcaggctaaa

SEQ ID NO: 48676 - DNA, 24 bp, Homo sapiens
agacaaaggctttacaggaggcat

SEQ ID NO: 48677 - DNA, 24 bp, Homo sapiens
attcatccttgatttgaatcaaga

SEQ ID NO: 48678 - DNA, 24 bp, Homo sapiens
aattcatccttgatttgaatcaag

SEQ ID NO: 48679 - DNA, 24 bp, Homo sapiens
gaattcatccttgatttgaatcaa

SEQ ID NO: 48680 - DNA, 24 bp, Homo sapiens
cagagctgtagctccctgtgccgg

SEQ ID NO: 48681 - DNA, 24 bp, Homo sapiens
acagagctgtagctccctgtgccg

SEQ ID NO: 48682 - DNA, 24 bp, Homo sapiens
cacagagctgtagctccctgtgcc

SEQ ID NO: 48683 - DNA, 24 bp, Homo sapiens
gaggaaatcaagtatgaacagatt

SEQ ID NO: 48684 - DNA, 24 bp, Homo sapiens
agaggaaatcaagtatgaacagat

SEQ ID NO: 48685 - DNA, 24 bp, Homo sapiens
aagaggaaatcaagtatgaacaga

SEQ ID NO: 48686 - DNA, 23 bp, Homo sapiens
gctgctgggctgtgaagtggaag

SEQ ID NO: 48687 - DNA, 24 bp, Homo sapiens
ggatgaatgtgatgacgaccaggc

SEQ ID NO: 48688 - DNA, 25 bp, Homo sapiens
ccacggtcatagacagcaccataca

SEQ ID NO: 48689 - DNA, 24 bp, Homo sapiens
gctggtgactgttggtggctatgg

SEQ ID NO: 48690 - DNA, 24 bp, Homo sapiens
cactgacgaagatcctggcaagtt

SEQ ID NO: 48691 - DNA, 24 bp, Homo sapiens
gcacgctgtcagtggagacttcat

SEQ ID NO: 48692 - DNA, 24 bp, Homo sapiens
atgaggatgagatacaccccctac

SEQ ID NO: 48693 - DNA, 24 bp, Homo sapiens
gatgaggatgagatacacccccta

SEQ ID NO: 48694 - DNA, 24 bp, Homo sapiens
ggatgaggatgagatacaccccct

SEQ ID NO: 48695 - DNA, 24 bp, Homo sapiens
atggtatgcagatgatgaataagg

SEQ ID NO: 48696 - DNA, 24 bp, Homo sapiens
tatggtatgcagatgatgaataag

SEQ ID NO: 48697 - DNA, 24 bp, Homo sapiens
ctatggtatgcagatgatgaataa

SEQ ID NO: 48698 - DNA, 24 bp, Homo sapiens
caaaagttttgtgataaatgctgc

SEQ ID NO: 48699 - DNA, 24 bp, Homo sapiens
tcaaaagttttgtgataaatgctg

SEQ ID NO: 48700 - DNA, 24 bp, Homo sapiens
gtcaaaagttttgtgataaatgct

SEQ ID NO: 48701 - DNA, 23 bp, Homo sapiens
ctggcagcagtgacagcagcagc

SEQ ID NO: 48702 - DNA, 23 bp, Homo sapiens
ctgctcggtcgatgcctgtgcca

SEQ ID NO: 48703 - DNA, 23 bp, Homo sapiens
tccaggcatgaggtggttcctgc

SEQ ID NO: 48704 - DNA, 24 bp, Homo sapiens
caagtttacaggtatcaatatttg

SEQ ID NO: 48705 - DNA, 24 bp, Homo sapiens
acaagtttacaggtatcaatattt

SEQ ID NO: 48706 - DNA, 24 bp, Homo sapiens
aacaagtttacaggtatcaatatt

SEQ ID NO: 48707 - DNA, 24 bp, Homo sapiens
ccaaatccaggagcaacgccagtg

SEQ ID NO: 48708 - DNA, 24 bp, Homo sapiens
ggcaccaaggcaacggcaccattg

SEQ ID NO: 48709 - DNA, 24 bp, Homo sapiens
gagcatcaggatactcaaagtgga

SEQ ID NO: 48710 - DNA, 24 bp, Homo sapiens
atacctgacagagtacaacgccaa

SEQ ID NO: 48711 - DNA, 24 bp, Homo sapiens
cgacaatgtaactcagcgtcttcc

SEQ ID NO: 48712 - DNA, 24 bp, Homo sapiens
gattcatactggtggctgggtggc

SEQ ID NO: 48713 - DNA, 24 bp, Homo sapiens
gcaggagccaggaactttcaggac

SEQ ID NO: 48714 - DNA, 24 bp, Homo sapiens
agcaggagccaggaactttcagga

SEQ ID NO: 48715 - DNA, 24 bp, Homo sapiens
cagcaggagccaggaactttcagg

SEQ ID NO: 48716 - DNA, 23 bp, Homo sapiens
cccctgccaccacccagccacag

SEQ ID NO: 48717 - DNA, 23 bp, Homo sapiens
gtttcaggcccagctgcagactg

SEQ ID NO: 48718 - DNA, 23 bp, Homo sapiens
acacagccccccgcccagccagc

SEQ ID NO: 48719 - DNA, 24 bp, Homo sapiens
tattctttcaggaaacacaaaacc

SEQ ID NO: 48720 - DNA, 24 bp, Homo sapiens
ttattctttcaggaaacacaaaac

SEQ ID NO: 48721 - DNA, 24 bp, Homo sapiens
cttattctttcaggaaacacaaaa

SEQ ID NO: 48722 - DNA, 24 bp, Homo sapiens
tcccgactaccagagcccgagagg

SEQ ID NO: 48723 - DNA, 24 bp, Homo sapiens
tgccgccgccgccaccaccatcag

SEQ ID NO: 48724 - DNA, 24 bp, Homo sapiens
ggccagagcgagccgggcgagcgg

SEQ ID NO: 48725 - DNA, 24 bp, Homo sapiens
tcccgactaccagagcccgagagg

SEQ ID NO: 48726 - DNA, 24 bp, Homo sapiens
ctgccgccgccgccaccaccatca

SEQ ID NO: 48727 - DNA, 24 bp, Homo sapiens
ggccagagcgagccgggcgagcgg

SEQ ID NO: 48728 - DNA, 24 bp, Homo sapiens
ctctgggctggctcacgtggaaaa

SEQ ID NO: 48729 - DNA, 24 bp, Homo sapiens
gctctgggctggctcacgtggaaa

SEQ ID NO: 48730 - DNA, 24 bp, Homo sapiens
agctctgggctggctcacgtggaa

SEQ ID NO: 48731 - DNA, 24 bp, Homo sapiens
ttcacacgtagaaccaagatagaa

SEQ ID NO: 48732 - DNA, 24 bp, Homo sapiens
tttcacacgtagaaccaagataga

SEQ ID NO: 48733 - DNA, 24 bp, Homo sapiens
ctttcacacgtagaaccaagatag

SEQ ID NO: 48734 - DNA, 24 bp, Homo sapiens
cggactgaaataagcggagcggaa

SEQ ID NO: 48735 - DNA, 24 bp, Homo sapiens
atgtgcgagtatctgctgaaggtc

SEQ ID NO: 48736 - DNA, 24 bp, Homo sapiens
tcaggatggactcaaagccgtgga

SEQ ID NO: 48737 - DNA, 24 bp, Homo sapiens
tttctgctcagatctttataaaca

SEQ ID NO: 48738 - DNA, 24 bp, Homo sapiens
atttctgctcagatctttataaac

SEQ ID NO: 48739 - DNA, 24 bp, Homo sapiens
aatttctgctcagatctttataaa

SEQ ID NO: 48740 - DNA, 24 bp, Homo sapiens
aggggcagcaggtcaccgtggacg

SEQ ID NO: 48741 - DNA, 24 bp, Homo sapiens
caggggcagcaggtcaccgtggac

SEQ ID NO: 48742 - DNA, 24 bp, Homo sapiens
tcaggggcagcaggtcaccgtgga

SEQ ID NO: 48743 - DNA, 24 bp, Homo sapiens
ggttggctgtggtggacggcgtgt

SEQ ID NO: 48744 - DNA, 24 bp, Homo sapiens
aggttggctgtggtggacggcgtg

SEQ ID NO: 48745 - DNA, 24 bp, Homo sapiens
caggttggctgtggtggacggcgt

SEQ ID NO: 48746 - DNA, 24 bp, Homo sapiens
cctcgtgtccacaatgctccgtac

SEQ ID NO: 48747 - DNA, 24 bp, Homo sapiens
gtgtggctgccgtgtggatggcac

SEQ ID NO: 48748 - DNA, 24 bp, Homo sapiens
gatgccctcaactatgctctccgc

SEQ ID NO: 48749 - DNA, 24 bp, Homo sapiens
tcggagagacgcaataaaccaagc

SEQ ID NO: 48750 - DNA, 24 bp, Homo sapiens
cagcagccacagtgaacagcaaga

SEQ ID NO: 48751 - DNA, 24 bp, Homo sapiens
gtgagtgcaagcacaacaaatcag

SEQ ID NO: 48752 - DNA, 24 bp, Homo sapiens
tgtgagtgcaagcacaacaaatca

SEQ ID NO: 48753 - DNA, 24 bp, Homo sapiens
ttgtgagtgcaagcacaacaaatc

SEQ ID NO: 48754 - DNA, 24 bp, Homo sapiens
gttgtgataaggttaaacagtgca

SEQ ID NO: 48755 - DNA, 24 bp, Homo sapiens
tgttgtgataaggttaaacagtgc

SEQ ID NO: 48756 - DNA, 24 bp, Homo sapiens
atgttgtgataaggttaaacagtg

SEQ ID NO: 48757 - DNA, 24 bp, Homo sapiens
ttttatttaagagtgttgatttca

SEQ ID NO: 48758 - DNA, 24 bp, Homo sapiens
gttttatttaagagtgttgatttc

SEQ ID NO: 48759 - DNA, 24 bp, Homo sapiens
tgttttatttaagagtgttgattt

SEQ ID NO: 48760 - DNA, 24 bp, Homo sapiens
gcaacctccgcttcccagattcaa

SEQ ID NO: 48761 - DNA, 24 bp, Homo sapiens
aggctggatggagtacagtggtgt

SEQ ID NO: 48762 - DNA, 24 bp, Homo sapiens
ttgagatacagtcgtgttgatgtt

SEQ ID NO: 48763 - DNA, 24 bp, Homo sapiens
tgtccagatcagaggctccgttcc

SEQ ID NO: 48764 - DNA, 24 bp, Homo sapiens
acttcgtggagacagagcagatga

SEQ ID NO: 48765 - DNA, 24 bp, Homo sapiens
cgcacaggcactcgcttccacacc

SEQ ID NO: 48766 - DNA, 25 bp, Homo sapiens
ggaagccttcagatgaggagttcgc

SEQ ID NO: 48767 - DNA, 25 bp, Homo sapiens
tctctgctacaaggaggatcttagt

SEQ ID NO: 48768 - DNA, 23 bp, Homo sapiens
ccagcaagcacgcagacagcaag

SEQ ID NO: 48769 - DNA, 25 bp, Homo sapiens
gcctctttggttttgttttctcagc

SEQ ID NO: 48770 - DNA, 23 bp, Homo sapiens
gcgtgctggtgctgctgaacccg

SEQ ID NO: 48771 - DNA, 23 bp, Homo sapiens
cttgcagctcttccggagtcacg

SEQ ID NO: 48772 - DNA, 24 bp, Homo sapiens
atcagcttctggtccatcggagga

SEQ ID NO: 48773 - DNA, 24 bp, Homo sapiens
ggatgggaaatgggtccaccagga

SEQ ID NO: 48774 - DNA, 24 bp, Homo sapiens
aaggtgaaacacggacacttcggg

SEQ ID NO: 48775 - DNA, 24 bp, Homo sapiens
ttgtggaagagagtccagaaaacc

SEQ ID NO: 48776 - DNA, 24 bp, Homo sapiens
tttgtggaagagagtccagaaaac

SEQ ID NO: 48777 - DNA, 24 bp, Homo sapiens
ttttgtggaagagagtccagaaaa

SEQ ID NO: 48778 - DNA, 24 bp, Homo sapiens
attttgaataggctaataataata

SEQ ID NO: 48779 - DNA, 24 bp, Homo sapiens
cattttgaataggctaataataat

SEQ ID NO: 48780 - DNA, 24 bp, Homo sapiens
acattttgaataggctaataataa

SEQ ID NO: 48781 - DNA, 24 bp, Homo sapiens
gcatacggaaggatatcacgcagc

SEQ ID NO: 48782 - DNA, 24 bp, Homo sapiens
ggcatacggaaggatatcacgcag

SEQ ID NO: 48783 - DNA, 24 bp, Homo sapiens
tggcatacggaaggatatcacgca

SEQ ID NO: 48784 - DNA, 24 bp, Homo sapiens
atacaaatcgggtagataaagtgg

SEQ ID NO: 48785 - DNA, 24 bp, Homo sapiens
tatacaaatcgggtagataaagtg

SEQ ID NO: 48786 - DNA, 24 bp, Homo sapiens
gtatacaaatcgggtagataaagt

SEQ ID NO: 48787 - DNA, 23 bp, Homo sapiens
ggaagctctttcaccgccaaccg

SEQ ID NO: 48788 - DNA, 23 bp, Homo sapiens
aaaggagcaggaacggcagcagc

SEQ ID NO: 48789 - DNA, 23 bp, Homo sapiens
accaccctagtctcctagtcgcc

SEQ ID NO: 48790 - DNA, 24 bp, Homo sapiens
aaacggatagatatgaaaaagttc

SEQ ID NO: 48791 - DNA, 24 bp, Homo sapiens
gaaacggatagatatgaaaaagtt

SEQ ID NO: 48792 - DNA, 24 bp, Homo sapiens
agaaacggatagatatgaaaaagt

SEQ ID NO: 48793 - DNA, 24 bp, Homo sapiens
gtattttgtagtgcctccacttct

SEQ ID NO: 48794 - DNA, 24 bp, Homo sapiens
tgtattttgtagtgcctccacttc

SEQ ID NO: 48795 - DNA, 24 bp, Homo sapiens
ttgtattttgtagtgcctccactt

SEQ ID NO: 48796 - DNA, 24 bp, Homo sapiens
gctatgacctgggggaagtggagt

SEQ ID NO: 48797 - DNA, 24 bp, Homo sapiens
ggctatgacctgggggaagtggag

SEQ ID NO: 48798 - DNA, 24 bp, Homo sapiens
gggctatgacctgggggaagtgga

SEQ ID NO: 48799 - DNA, 24 bp, Homo sapiens
ggcacggcagcaggtaaacgagag

SEQ ID NO: 48800 - DNA, 24 bp, Homo sapiens
aatccctacatcaccctcagcccg

SEQ ID NO: 48801 - DNA, 24 bp, Homo sapiens
cgcacgatcagttcaaggcaacac

SEQ ID NO: 48802 - DNA, 24 bp, Homo sapiens
gtgaggctgtggtgcgtgcctcga

SEQ ID NO: 48803 - DNA, 24 bp, Homo sapiens
cgtgaggctgtggtgcgtgcctcg

SEQ ID NO: 48804 - DNA, 24 bp, Homo sapiens
acgtgaggctgtggtgcgtgcctc

SEQ ID NO: 48805 - DNA, 24 bp, Homo sapiens
gtttacaaaaggtctgtgaactag

SEQ ID NO: 48806 - DNA, 24 bp, Homo sapiens
tgtttacaaaaggtctgtgaacta

SEQ ID NO: 48807 - DNA, 24 bp, Homo sapiens
ttgtttacaaaaggtctgtgaact

SEQ ID NO: 48808 - DNA, 23 bp, Homo sapiens
aggatggtggtgccttcgctgaa

SEQ ID NO: 48809 - DNA, 24 bp, Homo sapiens
ggacctcatcgaagagattcgcgg

SEQ ID NO: 48810 - DNA, 24 bp, Homo sapiens
ccagaccaccgacagcaagatcct

SEQ ID NO: 48811 - DNA, 24 bp, Homo sapiens
ggcggtccgaaggcatcaagtatc

SEQ ID NO: 48812 - DNA, 24 bp, Homo sapiens
agtctgtcaacctcttggtcagcg

SEQ ID NO: 48813 - DNA, 24 bp, Homo sapiens
atggtgaatggacaccaactctac

SEQ ID NO: 48814 - DNA, 24 bp, Homo sapiens
aatggtgaatggacaccaactcta

SEQ ID NO: 48815 - DNA, 24 bp, Homo sapiens
taatggtgaatggacaccaactct

SEQ ID NO: 48816 - DNA, 24 bp, Homo sapiens
aaatttcattggtaagtttttatt

SEQ ID NO: 48817 - DNA, 24 bp, Homo sapiens
aaaatttcattggtaagtttttat

SEQ ID NO: 48818 - DNA, 24 bp, Homo sapiens
caaaatttcattggtaagttttta

SEQ ID NO: 48819 - DNA, 23 bp, Homo sapiens
caccgccaccgccaccaccgccg

SEQ ID NO: 48820 - DNA, 23 bp, Homo sapiens
ccacacgcccaccacattcatca

SEQ ID NO: 48821 - DNA, 23 bp, Homo sapiens
atgagtccctgctctctgcggag

SEQ ID NO: 48822 - DNA, 23 bp, Homo sapiens
aaggaggaggaggaggaggagca

SEQ ID NO: 48823 - DNA, 23 bp, Homo sapiens
gcggcatcgtggacagcaagtac

SEQ ID NO: 48824 - DNA, 24 bp, Homo sapiens
catcctggtcaacaccgtcagcat

SEQ ID NO: 48825 - DNA, 23 bp, Homo sapiens
cggacggtggcttgtctgtgctg

SEQ ID NO: 48826 - DNA, 23 bp, Homo sapiens
ggcatcatcgtggtcatcagcgt

SEQ ID NO: 48827 - DNA, 24 bp, Homo sapiens
tttgccctggagatgctgctgaag

SEQ ID NO: 48828 - DNA, 24 bp, Homo sapiens
gtggtcatcagcgtgtgggagatc

SEQ ID NO: 48829 - DNA, 24 bp, Homo sapiens
tgtggtcatcagcgtgtgggagat

SEQ ID NO: 48830 - DNA, 24 bp, Homo sapiens
ttgtggtcatcagcgtgtgggaga

SEQ ID NO: 48831 - DNA, 25 bp, Homo sapiens
tctctagctctgacggatgactctt

SEQ ID NO: 48832 - DNA, 23 bp, Homo sapiens
atgacatgcacacactcttactt

SEQ ID NO: 48833 - DNA, 24 bp, Homo sapiens
acgtcagagattgtgtctgaaccg

SEQ ID NO: 48834 - DNA, 23 bp, Homo sapiens
tgtcaggacagtccgtgtgctgc

SEQ ID NO: 48835 - DNA, 25 bp, Homo sapiens
cgtggagatggtggtgaagatggtg

SEQ ID NO: 48836 - DNA, 25 bp, Homo sapiens
ttggtcatccttctcaactgcgtga

SEQ ID NO: 48837 - DNA, 23 bp, Homo sapiens
ggaccttccgcctgatgcgtgtg

SEQ ID NO: 48838 - DNA, 23 bp, Homo sapiens
agctggtggtgctcatgaagacc

SEQ ID NO: 48839 - DNA, 23 bp, Homo sapiens
ggccaccttctgcatgctgctta

SEQ ID NO: 48840 - DNA, 23 bp, Homo sapiens
gctggtggtggagacgctgatgt

SEQ ID NO: 48841 - DNA, 25 bp, Homo sapiens
gtcatctgctgtgccttcttcatca

SEQ ID NO: 48842 - DNA, 24 bp, Homo sapiens
ggcgaggataccaggaacatcacc

SEQ ID NO: 48843 - DNA, 24 bp, Homo sapiens
gccttcacaacctacgaaactaca

SEQ ID NO: 48844 - DNA, 24 bp, Homo sapiens
ggccttcacaacctacgaaactac

SEQ ID NO: 48845 - DNA, 24 bp, Homo sapiens
aggccttcacaacctacgaaacta

SEQ ID NO: 48846 - DNA, 24 bp, Homo sapiens
tgaagaaggacgccttagaaaatt

SEQ ID NO: 48847 - DNA, 24 bp, Homo sapiens
gtgaagaaggacgccttagaaaat

SEQ ID NO: 48848 - DNA, 24 bp, Homo sapiens
agtgaagaaggacgccttagaaaa

SEQ ID NO: 48849 - DNA, 24 bp, Homo sapiens
ctttattctaggatactgtaacac

SEQ ID NO: 48850 - DNA, 24 bp, Homo sapiens
gctttattctaggatactgtaaca

SEQ ID NO: 48851 - DNA, 24 bp, Homo sapiens
tgctttattctaggatactgtaac

SEQ ID NO: 48852 - DNA, 24 bp, Homo sapiens
aagaaaagtagaaataataaattt

SEQ ID NO: 48853 - DNA, 24 bp, Homo sapiens
caagaaaagtagaaataataaatt

SEQ ID NO: 48854 - DNA, 24 bp, Homo sapiens
ccaagaaaagtagaaataataaat

SEQ ID NO: 48855 - DNA, 24 bp, Homo sapiens
tcatattttaggtattctctgaaa

SEQ ID NO: 48856 - DNA, 24 bp, Homo sapiens
atcatattttaggtattctctgaa

SEQ ID NO: 48857 - DNA, 24 bp, Homo sapiens
tatcatattttaggtattctctga

SEQ ID NO: 48858 - DNA, 24 bp, Homo sapiens
tagaactaatggtaagtaaatctt

SEQ ID NO: 48859 - DNA, 24 bp, Homo sapiens
ttagaactaatggtaagtaaatct

SEQ ID NO: 48860 - DNA, 24 bp, Homo sapiens
gttagaactaatggtaagtaaatc

SEQ ID NO: 48861 - DNA, 24 bp, Homo sapiens
catttctataggaggatagtgaat

SEQ ID NO: 48862 - DNA, 24 bp, Homo sapiens
acatttctataggaggatagtgaa

SEQ ID NO: 48863 - DNA, 24 bp, Homo sapiens
tacatttctataggaggatagtga

SEQ ID NO: 48864 - DNA, 24 bp, Homo sapiens
agatatttctagtaagttgcttaa

SEQ ID NO: 48865 - DNA, 24 bp, Homo sapiens
cagatatttctagtaagttgctta

SEQ ID NO: 48866 - DNA, 24 bp, Homo sapiens
tcagatatttctagtaagttgctt

SEQ ID NO: 48867 - DNA, 24 bp, Homo sapiens
taaagagcttggtgagtcaataat

SEQ ID NO: 48868 - DNA, 24 bp, Homo sapiens
ttaaagagcttggtgagtcaataa

SEQ ID NO: 48869 - DNA, 24 bp, Homo sapiens
tttaaagagcttggtgagtcaata

SEQ ID NO: 48870 - DNA, 24 bp, Homo sapiens
gctgggccatggctccagtgagga

SEQ ID NO: 48871 - DNA, 24 bp, Homo sapiens
ggctgggccatggctccagtgagg

SEQ ID NO: 48872 - DNA, 24 bp, Homo sapiens
cggctgggccatggctccagtgag

SEQ ID NO: 48873 - DNA, 24 bp, Homo sapiens
ctgaggaaccgtctgctgctgctg

SEQ ID NO: 48874 - DNA, 24 bp, Homo sapiens
ctcagcacataccctcgcctggtc

SEQ ID NO: 48875 - DNA, 24 bp, Homo sapiens
gggtaagaaggtcaaccgtgtggc

SEQ ID NO: 48876 - DNA, 24 bp, Homo sapiens
tttagtgaaagccctgataatttg

SEQ ID NO: 48877 - DNA, 24 bp, Homo sapiens
ttttagtgaaagccctgataattt

SEQ ID NO: 48878 - DNA, 24 bp, Homo sapiens
gttttagtgaaagccctgataatt

SEQ ID NO: 48879 - DNA, 24 bp, Homo sapiens
gattttatacaaactcaagcagtg

SEQ ID NO: 48880 - DNA, 24 bp, Homo sapiens
ggattttatacaaactcaagcagt

SEQ ID NO: 48881 - DNA, 24 bp, Homo sapiens
aggattttatacaaactcaagcag

SEQ ID NO: 48882 - DNA, 24 bp, Homo sapiens
tatattcacagggtaaaccagact

SEQ ID NO: 48883 - DNA, 24 bp, Homo sapiens
ttatattcacagggtaaaccagac

SEQ ID NO: 48884 - DNA, 24 bp, Homo sapiens
tttatattcacagggtaaaccaga

SEQ ID NO: 48885 - DNA, 24 bp, Homo sapiens
aatgaaggatattaatgtaaatta

SEQ ID NO: 48886 - DNA, 24 bp, Homo sapiens
aaatgaaggatattaatgtaaatt

SEQ ID NO: 48887 - DNA, 24 bp, Homo sapiens
taaatgaaggatattaatgtaaat

SEQ ID NO: 48888 - DNA, 24 bp, Homo sapiens
tgaagaggaaatgttggagaaatc

SEQ ID NO: 48889 - DNA, 24 bp, Homo sapiens
ctgaagaggaaatgttggagaaat

SEQ ID NO: 48890 - DNA, 24 bp, Homo sapiens
gctgaagaggaaatgttggagaaa

SEQ ID NO: 48891 - DNA, 24 bp, Homo sapiens
ctcagcacaccagccgccaccatc

SEQ ID NO: 48892 - DNA, 24 bp, Homo sapiens
gtcagcagccgccaccatcaaacc

SEQ ID NO: 48893 - DNA, 24 bp, Homo sapiens
gcctttccgccttctctgagttcg

SEQ ID NO: 48894 - DNA, 24 bp, Homo sapiens
gtcagcagccgccaccatcaaacc

SEQ ID NO: 48895 - DNA, 24 bp, Homo sapiens
ctcagcacaccagccgccaccatc

SEQ ID NO: 48896 - DNA, 24 bp, Homo sapiens
cggttggagcactcagcagaggag

SEQ ID NO: 48897 - DNA, 24 bp, Homo sapiens
tgaccttcagttctgctacagtgt

SEQ ID NO: 48898 - DNA, 24 bp, Homo sapiens
cctgggctggttgtgctggctgac

SEQ ID NO: 48899 - DNA, 24 bp, Homo sapiens
gattgcttcagagagttctgggat

SEQ ID NO: 48900 - DNA, 24 bp, Homo sapiens
agattgcttcagagagttctggga

SEQ ID NO: 48901 - DNA, 24 bp, Homo sapiens
cagattgcttcagagagttctggg

SEQ ID NO: 48902 - DNA, 24 bp, Homo sapiens
ttttattgcagttatcatttttta

SEQ ID NO: 48903 - DNA, 24 bp, Homo sapiens
attttattgcagttatcatttttt

SEQ ID NO: 48904 - DNA, 24 bp, Homo sapiens
cattttattgcagttatcattttt

SEQ ID NO: 48905 - DNA, 24 bp, Homo sapiens
ctggagaacaggagcagcagcatc

SEQ ID NO: 48906 - DNA, 24 bp, Homo sapiens
tggactcactcaatgccaggatgg

SEQ ID NO: 48907 - DNA, 24 bp, Homo sapiens
tgcaggaggacagccaggtcactg

SEQ ID NO: 48908 - DNA, 23 bp, Homo sapiens
gctgcgatgcctgtataacccag

SEQ ID NO: 48909 - DNA, 23 bp, Homo sapiens
tgctccagcctggcggacagcat

SEQ ID NO: 48910 - DNA, 24 bp, Homo sapiens
ttcttttgtagctgaataatttgg

SEQ ID NO: 48911 - DNA, 24 bp, Homo sapiens
tttcttttgtagctgaataatttg

SEQ ID NO: 48912 - DNA, 24 bp, Homo sapiens
ctttcttttgtagctgaataattt

SEQ ID NO: 48913 - DNA, 23 bp, Homo sapiens
ggctggaggctggagtgctgtac

SEQ ID NO: 48914 - DNA, 23 bp, Homo sapiens
gtctccaccacgctgaccatcaa

SEQ ID NO: 48915 - DNA, 24 bp, Homo sapiens
agttactcaaccgcagcagtgtgg

SEQ ID NO: 48916 - DNA, 24 bp, Homo sapiens
actggaaagcaacaaagagacggg

SEQ ID NO: 48917 - DNA, 24 bp, Homo sapiens
agtctaacttgccactctgtgaac

SEQ ID NO: 48918 - DNA, 23 bp, Homo sapiens
acgttgcccaggctggcttcaaa

SEQ ID NO: 48919 - DNA, 23 bp, Homo sapiens
ccgaacagcacctcaggagcaga

SEQ ID NO: 48920 - DNA, 23 bp, Homo sapiens
gattgtcagcacccaactcccgc

SEQ ID NO: 48921 - DNA, 23 bp, Homo sapiens
cgctcgcctcacattctcgctgg

SEQ ID NO: 48922 - DNA, 24 bp, Homo sapiens
tataattacagtctgggattatat

SEQ ID NO: 48923 - DNA, 24 bp, Homo sapiens
ctataattacagtctgggattata

SEQ ID NO: 48924 - DNA, 24 bp, Homo sapiens
tctataattacagtctgggattat

SEQ ID NO: 48925 - DNA, 24 bp, Homo sapiens
aggaataccagctcagccgttacc

SEQ ID NO: 48926 - DNA, 24 bp, Homo sapiens
caggaataccagctcagccgttac

SEQ ID NO: 48927 - DNA, 24 bp, Homo sapiens
acaggaataccagctcagccgtta

SEQ ID NO: 48928 - DNA, 24 bp, Homo sapiens
caacacgccagccctggagcccca

SEQ ID NO: 48929 - DNA, 24 bp, Homo sapiens
acaacacgccagccctggagcccc

SEQ ID NO: 48930 - DNA, 24 bp, Homo sapiens
gacaacacgccagccctggagccc

SEQ ID NO: 48931 - DNA, 24 bp, Homo sapiens
cctccatcaagtcctccacctcgt

SEQ ID NO: 48932 - DNA, 25 bp, Homo sapiens
gaggaggaggagccagagaagaagg

SEQ ID NO: 48933 - DNA, 24 bp, Homo sapiens
gcttacagacatccgcttggaggc

SEQ ID NO: 48934 - DNA, 24 bp, Homo sapiens
aagtgttcaaggtctgaaggagaa

SEQ ID NO: 48935 - DNA, 24 bp, Homo sapiens
caagtgttcaaggtctgaaggaga

SEQ ID NO: 48936 - DNA, 24 bp, Homo sapiens
ccaagtgttcaaggtctgaaggag

SEQ ID NO: 48937 - DNA, 23 bp, Homo sapiens
cagcaagatgtgacagatggcgt

SEQ ID NO: 48938 - DNA, 24 bp, Homo sapiens
acatcaatggctgtccgaagaaca

SEQ ID NO: 48939 - DNA, 23 bp, Homo sapiens
cgatacaagcagcagcagcagca

SEQ ID NO: 48940 - DNA, 24 bp, Homo sapiens
tcgatacccagcaaatgaaaagat

SEQ ID NO: 48941 - DNA, 24 bp, Homo sapiens
ttcgatacccagcaaatgaaaaga

SEQ ID NO: 48942 - DNA, 24 bp, Homo sapiens
gttcgatacccagcaaatgaaaag

SEQ ID NO: 48943 - DNA, 24 bp, Homo sapiens
cccattattgacaatccaaaggtg

SEQ ID NO: 48944 - DNA, 24 bp, Homo sapiens
gagagcttatctacacgactcaga

SEQ ID NO: 48945 - DNA, 25 bp, Homo sapiens
accgcaacattaagattacaagtgg

SEQ ID NO: 48946 - DNA, 24 bp, Homo sapiens
acgtgtaggagattttgttagtgg

SEQ ID NO: 48947 - DNA, 24 bp, Homo sapiens
aacgtgtaggagattttgttagtg

SEQ ID NO: 48948 - DNA, 24 bp, Homo sapiens
caacgtgtaggagattttgttagt

SEQ ID NO: 48949 - DNA, 25 bp, Homo sapiens
ttctacctcaccgtgtatgcgacca

SEQ ID NO: 48950 - DNA, 23 bp, Homo sapiens
gaacgctgctgactggtggctct

SEQ ID NO: 48951 - DNA, 25 bp, Homo sapiens
gccttagccatcctcttctctctgc

SEQ ID NO: 48952 - DNA, 23 bp, Homo sapiens
ggatggagtgaccttctgcgtgc

SEQ ID NO: 48953 - DNA, 23 bp, Homo sapiens
gagagaagttgggcatcgtgggc

SEQ ID NO: 48954 - DNA, 24 bp, Homo sapiens
ttccctgttgttggtgctcttccg

SEQ ID NO: 48955 - DNA, 23 bp, Homo sapiens
agaggcggcagcaggcttcagag

SEQ ID NO: 48956 - DNA, 25 bp, Homo sapiens
acagaggttacaggaagtgcgagag

SEQ ID NO: 48957 - DNA, 23 bp, Homo sapiens
caggatgaggtggagcaggagcg

SEQ ID NO: 48958 - DNA, 23 bp, Homo sapiens
gaagccgcagaggtcatcctgga

SEQ ID NO: 48959 - DNA, 23 bp, Homo sapiens
cccacctcagcagtttcagccag

SEQ ID NO: 48960 - DNA, 23 bp, Homo sapiens
agaaggcgtggctggcaagagtg

SEQ ID NO: 48961 - DNA, 23 bp, Homo sapiens
agaaggcgtggctggcaagagtg

SEQ ID NO: 48962 - DNA, 23 bp, Homo sapiens
agaggcggcagcaggcttcagag

SEQ ID NO: 48963 - DNA, 25 bp, Homo sapiens
acagaggttacaggaagtgcgagag

SEQ ID NO: 48964 - DNA, 23 bp, Homo sapiens
cagaagcagcagcagcaactcct

SEQ ID NO: 48965 - DNA, 25 bp, Homo sapiens
tgtgagtaacagcaggctgtcatga

SEQ ID NO: 48966 - DNA, 24 bp, Homo sapiens
ccaagagtgaggaagataaaataa

SEQ ID NO: 48967 - DNA, 24 bp, Homo sapiens
cccaagagtgaggaagataaaata

SEQ ID NO: 48968 - DNA, 24 bp, Homo sapiens
gcccaagagtgaggaagataaaat

SEQ ID NO: 48969 - DNA, 24 bp, Homo sapiens
gcaacaactgaggcaatccagagg

SEQ ID NO: 48970 - DNA, 23 bp, Homo sapiens
cattactgcgaagccattggtgc

SEQ ID NO: 48971 - DNA, 24 bp, Homo sapiens
agaaagacgcagtggagacaggga

SEQ ID NO: 48972 - DNA, 24 bp, Homo sapiens
gcaacaactgaggcaatccagagg

SEQ ID NO: 48973 - DNA, 23 bp, Homo sapiens
gcagcagccacagtcaagagttt

SEQ ID NO: 48974 - DNA, 25 bp, Homo sapiens
actacaccgtgaagacagaccatct

SEQ ID NO: 48975 - DNA, 24 bp, Homo sapiens
ggaaatgagatggtttttgtcaaa

SEQ ID NO: 48976 - DNA, 24 bp, Homo sapiens
tggaaatgagatggtttttgtcaa

SEQ ID NO: 48977 - DNA, 24 bp, Homo sapiens
atggaaatgagatggtttttgtca

SEQ ID NO: 48978 - DNA, 24 bp, Homo sapiens
catcagagtggcagcagcggactg

SEQ ID NO: 48979 - DNA, 24 bp, Homo sapiens
gtaggtgtggctctgtgtgcgtga

SEQ ID NO: 48980 - DNA, 24 bp, Homo sapiens
gtcccagtccctgtagtctcctgc

SEQ ID NO: 48981 - DNA, 25 bp, Homo sapiens
aactgcttgagtcactatccactgg

SEQ ID NO: 48982 - DNA, 24 bp, Homo sapiens
aggttcataaggtataatcattat

SEQ ID NO: 48983 - DNA, 24 bp, Homo sapiens
gaggttcataaggtataatcatta

SEQ ID NO: 48984 - DNA, 24 bp, Homo sapiens
agaggttcataaggtataatcatt

SEQ ID NO: 48985 - DNA, 24 bp, Homo sapiens
tactttgaaaggtagaacataatt

SEQ ID NO: 48986 - DNA, 24 bp, Homo sapiens
atactttgaaaggtagaacataat

SEQ ID NO: 48987 - DNA, 24 bp, Homo sapiens
aatactttgaaaggtagaacataa

SEQ ID NO: 48988 - DNA, 25 bp, Homo sapiens
agagggcagcaaggttggactatga

SEQ ID NO: 48989 - DNA, 25 bp, Homo sapiens
cccagacaacaactcagaggacttt

SEQ ID NO: 48990 - DNA, 25 bp, Homo sapiens
tctatggacctctgtctcgtcttgg

SEQ ID NO: 48991 - DNA, 24 bp, Homo sapiens
cattatgatcgcaacccagggaca

SEQ ID NO: 48992 - DNA, 24 bp, Homo sapiens
ccattatgatcgcaacccagggac

SEQ ID NO: 48993 - DNA, 24 bp, Homo sapiens
tccattatgatcgcaacccaggga

SEQ ID NO: 48994 - DNA, 24 bp, Homo sapiens
actctctaaaggtgcccaagtaga

SEQ ID NO: 48995 - DNA, 24 bp, Homo sapiens
tactctctaaaggtgcccaagtag

SEQ ID NO: 48996 - DNA, 24 bp, Homo sapiens
ctactctctaaaggtgcccaagta

SEQ ID NO: 48997 - DNA, 23 bp, Homo sapiens
agcagcagcagcagtagcagcag

SEQ ID NO: 48998 - DNA, 24 bp, Homo sapiens
ttctctgctgtgatccatactcgg

SEQ ID NO: 48999 - DNA, 24 bp, Homo sapiens
tcacctttgacctgtctggctcac

SEQ ID NO: 49000 - DNA, 24 bp, Homo sapiens
aaatttctcagtgttataggttca

SEQ ID NO: 49001 - DNA, 24 bp, Homo sapiens
taaatttctcagtgttataggttc

SEQ ID NO: 49002 - DNA, 24 bp, Homo sapiens
ctaaatttctcagtgttataggtt

SEQ ID NO: 49003 - DNA, 24 bp, Homo sapiens
cctaggggccagttttccttcccg

SEQ ID NO: 49004 - DNA, 24 bp, Homo sapiens
gcctaggggccagttttccttccc

SEQ ID NO: 49005 - DNA, 24 bp, Homo sapiens
cgcctaggggccagttttccttcc

SEQ ID NO: 49006 - DNA, 24 bp, Homo sapiens
caacgctccgccttcttgtttcag

SEQ ID NO: 49007 - DNA, 24 bp, Homo sapiens
cagagtgctgaaaagtttgagtcc

SEQ ID NO: 49008 - DNA, 24 bp, Homo sapiens
cggtggctcatgcctgtcatcccg

SEQ ID NO: 49009 - DNA, 24 bp, Homo sapiens
gagccagcgccgccctgcccccgt

SEQ ID NO: 49010 - DNA, 24 bp, Homo sapiens
agagccagcgccgccctgcccccg

SEQ ID NO: 49011 - DNA, 24 bp, Homo sapiens
cagagccagcgccgccctgccccc

SEQ ID NO: 49012 - DNA, 24 bp, Homo sapiens
ccgaggctgaagcagaaccagagc

SEQ ID NO: 49013 - DNA, 24 bp, Homo sapiens
gacccagagcccgagcccgacttc

SEQ ID NO: 49014 - DNA, 24 bp, Homo sapiens
ggttgcccagagcttcagaccctg

SEQ ID NO: 49015 - DNA, 25 bp, Homo sapiens
cactcaatgtcatcaaggaaggcga

SEQ ID NO: 49016 - DNA, 23 bp, Homo sapiens
tcaagcagttccagcagcagcag

SEQ ID NO: 49017 - DNA, 25 bp, Homo sapiens
aggagatgttggaggatgtctgtgc

SEQ ID NO: 49018 - DNA, 25 bp, Homo sapiens
accttggacacttacctcgtcatcg

SEQ ID NO: 49019 - DNA, 25 bp, Homo sapiens
cagttcagagtcagtgccagtaacc

SEQ ID NO: 49020 - DNA, 24 bp, Homo sapiens
tatgatgctgctgctgatggtgcc

SEQ ID NO: 49021 - DNA, 24 bp, Homo sapiens
cgttctctcggacctgtcacaaag

SEQ ID NO: 49022 - DNA, 23 bp, Homo sapiens
cgtaatggcagcgccgtggcctc

SEQ ID NO: 49023 - DNA, 23 bp, Homo sapiens
cgccgccgccgccccctccctcc

SEQ ID NO: 49024 - DNA, 24 bp, Homo sapiens
ttaatttataggtatcaggacctc

SEQ ID NO: 49025 - DNA, 24 bp, Homo sapiens
attaatttataggtatcaggacct

SEQ ID NO: 49026 - DNA, 24 bp, Homo sapiens
tattaatttataggtatcaggacc

SEQ ID NO: 49027 - DNA, 24 bp, Homo sapiens
tttaataacagcaacttaggcatg

SEQ ID NO: 49028 - DNA, 24 bp, Homo sapiens
ttttaataacagcaacttaggcat

SEQ ID NO: 49029 - DNA, 24 bp, Homo sapiens
tttttaataacagcaacttaggca

SEQ ID NO: 49030 - DNA, 24 bp, Homo sapiens
gcactttagcagatttattggatc

SEQ ID NO: 49031 - DNA, 24 bp, Homo sapiens
agcactttagcagatttattggat

SEQ ID NO: 49032 - DNA, 24 bp, Homo sapiens
cagcactttagcagatttattgga

SEQ ID NO: 49033 - DNA, 24 bp, Homo sapiens
cccagaactacctcctgcgagaag

SEQ ID NO: 49034 - DNA, 24 bp, Homo sapiens
cagagccagatccgcatgtgcaag

SEQ ID NO: 49035 - DNA, 24 bp, Homo sapiens
gctgccccctcagcctccctgctg

SEQ ID NO: 49036 - DNA, 23 bp, Homo sapiens
cctctgggcttccaagttcctgg

SEQ ID NO: 49037 - DNA, 23 bp, Homo sapiens
ctgctcctcccgccatgaccctg

SEQ ID NO: 49038 - DNA, 23 bp, Homo sapiens
ctgctcagtgagctccgccgaca

SEQ ID NO: 49039 - DNA, 24 bp, Homo sapiens
attaggcacaaaactgatttcaat

SEQ ID NO: 49040 - DNA, 24 bp, Homo sapiens
aattaggcacaaaactgatttcaa

SEQ ID NO: 49041 - DNA, 24 bp, Homo sapiens
aaattaggcacaaaactgatttca

SEQ ID NO: 49042 - DNA, 24 bp, Homo sapiens
cacatctttagctatggcttttaa

SEQ ID NO: 49043 - DNA, 24 bp, Homo sapiens
tcacatctttagctatggctttta

SEQ ID NO: 49044 - DNA, 24 bp, Homo sapiens
ttcacatctttagctatggctttt

SEQ ID NO: 49045 - DNA, 24 bp, Homo sapiens
ggggacccttggcaagactcgtgg

SEQ ID NO: 49046 - DNA, 24 bp, Homo sapiens
cggggacccttggcaagactcgtg

SEQ ID NO: 49047 - DNA, 24 bp, Homo sapiens
gcggggacccttggcaagactcgt

SEQ ID NO: 49048 - DNA, 23 bp, Homo sapiens
tgctgatgctgatgctgttgcca

SEQ ID NO: 49049 - DNA, 24 bp, Homo sapiens
gcgagccagccacagagtaaagag

SEQ ID NO: 49050 - DNA, 25 bp, Homo sapiens
gcctctatctgagtgatactttgcc

SEQ ID NO: 49051 - DNA, 24 bp, Homo sapiens
atctcacgctgtcctccagtgtct

SEQ ID NO: 49052 - DNA, 23 bp, Homo sapiens
gtcacggcagcactatggtggac

SEQ ID NO: 49053 - DNA, 24 bp, Homo sapiens
gcaaggacaacaggcagaggctac

SEQ ID NO: 49054 - DNA, 23 bp, Homo sapiens
cacgaggagctggtgctgcggtg

SEQ ID NO: 49055 - DNA, 23 bp, Homo sapiens
gcctgggttcctggaaggacacc

SEQ ID NO: 49056 - DNA, 23 bp, Homo sapiens
gacagcgccgcttctctatcctc

SEQ ID NO: 49057 - DNA, 24 bp, Homo sapiens
gcttctctgctccttctggaatct

SEQ ID NO: 49058 - DNA, 24 bp, Homo sapiens
ctcctgcctccaccatgtccatca

SEQ ID NO: 49059 - DNA, 24 bp, Homo sapiens
tccagaagtcctacaaggtgtcca

SEQ ID NO: 49060 - DNA, 24 bp, Homo sapiens
tgaagggcaaaataaaaaatttat

SEQ ID NO: 49061 - DNA, 24 bp, Homo sapiens
ttgaagggcaaaataaaaaattta

SEQ ID NO: 49062 - DNA, 24 bp, Homo sapiens
tttgaagggcaaaataaaaaattt

SEQ ID NO: 49063 - DNA, 24 bp, Homo sapiens
tcttattacagataaaaaatttat

SEQ ID NO: 49064 - DNA, 24 bp, Homo sapiens
ttcttattacagataaaaaattta

SEQ ID NO: 49065 - DNA, 24 bp, Homo sapiens
cttcttattacagataaaaaattt

SEQ ID NO: 49066 - DNA, 24 bp, Homo sapiens
ttcaacacttatgttgtcatttct

SEQ ID NO: 49067 - DNA, 24 bp, Homo sapiens
attcaacacttatgttgtcatttc

SEQ ID NO: 49068 - DNA, 24 bp, Homo sapiens
cattcaacacttatgttgtcattt

SEQ ID NO: 49069 - DNA, 25 bp, Homo sapiens
aagattgataaacccaagtgcctgc

SEQ ID NO: 49070 - DNA, 25 bp, Homo sapiens
aagtgctgctcacattgtggactga

SEQ ID NO: 49071 - DNA, 25 bp, Homo sapiens
caatctcggctcactgcaacctctg

SEQ ID NO: 49072 - DNA, 24 bp, Homo sapiens
cagaggtctcggtccatcagcggt

SEQ ID NO: 49073 - DNA, 24 bp, Homo sapiens
cctttccaccagcccactcagcag

SEQ ID NO: 49074 - DNA, 24 bp, Homo sapiens
gcggctcaactccatcaagaacag

SEQ ID NO: 49075 - DNA, 24 bp, Homo sapiens
gaacttcttccgcagagcctccga

SEQ ID NO: 49076 - DNA, 24 bp, Homo sapiens
acttcaagcggctcatccagatcc

SEQ ID NO: 49077 - DNA, 24 bp, Homo sapiens
ccagtggtggtggctgacctcttc

SEQ ID NO: 49078 - DNA, 24 bp, Homo sapiens
acttcaagcggctcatccagatcc

SEQ ID NO: 49079 - DNA, 24 bp, Homo sapiens
ccagtggtggtggctgacctcttc

SEQ ID NO: 49080 - DNA, 24 bp, Homo sapiens
acgacagggacctccagattgaga

SEQ ID NO: 49081 - DNA, 24 bp, Homo sapiens
ccgctctgaactggagaagatcaa

SEQ ID NO: 49082 - DNA, 24 bp, Homo sapiens
gagcagcggaagcagaagcagaag

SEQ ID NO: 49083 - DNA, 24 bp, Homo sapiens
ctgcgtgaggaggctgagaggaag

SEQ ID NO: 49084 - DNA, 24 bp, Homo sapiens
gtatgaaaatgttaccagaaaaac

SEQ ID NO: 49085 - DNA, 24 bp, Homo sapiens
tgtatgaaaatgttaccagaaaaa

SEQ ID NO: 49086 - DNA, 24 bp, Homo sapiens
gtgtatgaaaatgttaccagaaaa

SEQ ID NO: 49087 - DNA, 24 bp, Homo sapiens
atgaagataagatcatcagtaacg

SEQ ID NO: 49088 - DNA, 24 bp, Homo sapiens
aatgaagataagatcatcagtaac

SEQ ID NO: 49089 - DNA, 24 bp, Homo sapiens
aaatgaagataagatcatcagtaa

SEQ ID NO: 49090 - DNA, 24 bp, Homo sapiens
atgaagataaggttagttgacact

SEQ ID NO: 49091 - DNA, 24 bp, Homo sapiens
aatgaagataaggttagttgacac

SEQ ID NO: 49092 - DNA, 24 bp, Homo sapiens
aaatgaagataaggttagttgaca

SEQ ID NO: 49093 - DNA, 23 bp, Homo sapiens
gagcccattgtcccgagagcctg

SEQ ID NO: 49094 - DNA, 23 bp, Homo sapiens
cttcgccccaactgcttctcctg

SEQ ID NO: 49095 - DNA, 23 bp, Homo sapiens
tgggtcccagcgaggtgatggct

SEQ ID NO: 49096 - DNA, 24 bp, Homo sapiens
tatcaacacagggaggagctgtgc

SEQ ID NO: 49097 - DNA, 24 bp, Homo sapiens
atatcaacacagggaggagctgtg

SEQ ID NO: 49098 - DNA, 24 bp, Homo sapiens
gatatcaacacagggaggagctgt

SEQ ID NO: 49099 - DNA, 24 bp, Homo sapiens
tttataaacaggactgtgtcattt

SEQ ID NO: 49100 - DNA, 24 bp, Homo sapiens
ttttataaacaggactgtgtcatt

SEQ ID NO: 49101 - DNA, 24 bp, Homo sapiens
tttttataaacaggactgtgtcat

SEQ ID NO: 49102 - DNA, 25 bp, Homo sapiens
acctcacacgaagaagtctggaaga

SEQ ID NO: 49103 - DNA, 23 bp, Homo sapiens
gagtggaaatgcctggaccctgc

SEQ ID NO: 49104 - DNA, 25 bp, Homo sapiens
tgttggagaactactggaaccttgt

SEQ ID NO: 49105 - DNA, 23 bp, Homo sapiens
gagtggaaatgcctggaccctgc

SEQ ID NO: 49106 - DNA, 25 bp, Homo sapiens
acctcacacgaagaagtctggaaga

SEQ ID NO: 49107 - DNA, 23 bp, Homo sapiens
caccgcaccctccacctcagaaa

SEQ ID NO: 49108 - DNA, 23 bp, Homo sapiens
ccagactacttccgcaggcaggc

SEQ ID NO: 49109 - DNA, 23 bp, Homo sapiens
aaggaggcagcgaagcagattaa

SEQ ID NO: 49110 - DNA, 24 bp, Homo sapiens
cagacaggtagcatggtgaagccg

SEQ ID NO: 49111 - DNA, 24 bp, Homo sapiens
catcctccctgctcagtctcccaa

SEQ ID NO: 49112 - DNA, 23 bp, Homo sapiens
cccttcgttcccacatgctccac

SEQ ID NO: 49113 - DNA, 23 bp, Homo sapiens
cagactggtctcaaactcctggc

SEQ ID NO: 49114 - DNA, 24 bp, Homo sapiens
tgaaaaatctgcctaaagatattg

SEQ ID NO: 49115 - DNA, 24 bp, Homo sapiens
ctgaaaaatctgcctaaagatatt

SEQ ID NO: 49116 - DNA, 24 bp, Homo sapiens
cctgaaaaatctgcctaaagatat

SEQ ID NO: 49117 - DNA, 24 bp, Homo sapiens
tcagttttaaggtgggccagggtt

SEQ ID NO: 49118 - DNA, 24 bp, Homo sapiens
ttcagttttaaggtgggccagggt

SEQ ID NO: 49119 - DNA, 24 bp, Homo sapiens
gttcagttttaaggtgggccaggg

SEQ ID NO: 49120 - DNA, 24 bp, Homo sapiens
gaagacgatcctccagtacccgcc

SEQ ID NO: 49121 - DNA, 24 bp, Homo sapiens
aaagcgggcaggcggcggaaatat

SEQ ID NO: 49122 - DNA, 24 bp, Homo sapiens
ctgagcggccaaacggcacggtcg

SEQ ID NO: 49123 - DNA, 24 bp, Homo sapiens
gctggaggcaggtcgctgtggttc

SEQ ID NO: 49124 - DNA, 24 bp, Homo sapiens
ggctggaggcaggtcgctgtggtt

SEQ ID NO: 49125 - DNA, 24 bp, Homo sapiens
aggctggaggcaggtcgctgtggt

SEQ ID NO: 49126 - DNA, 24 bp, Homo sapiens
aagcacccaagtcacctgttgaac

SEQ ID NO: 49127 - DNA, 24 bp, Homo sapiens
gggcattgaggcatttccatacat

SEQ ID NO: 49128 - DNA, 24 bp, Homo sapiens
cattaggctccttgctacttatgc

SEQ ID NO: 49129 - DNA, 24 bp, Homo sapiens
ttcttatccagaaacgtgtggtta

SEQ ID NO: 49130 - DNA, 24 bp, Homo sapiens
tttcttatccagaaacgtgtggtt

SEQ ID NO: 49131 - DNA, 24 bp, Homo sapiens
ttttcttatccagaaacgtgtggt

SEQ ID NO: 49132 - DNA, 24 bp, Homo sapiens
atttttacaaggttcctagaagcc

SEQ ID NO: 49133 - DNA, 24 bp, Homo sapiens
aatttttacaaggttcctagaagc

SEQ ID NO: 49134 - DNA, 24 bp, Homo sapiens
aaatttttacaaggttcctagaag

SEQ ID NO: 49135 - DNA, 24 bp, Homo sapiens
ctcccctgcagacaacgtcaaggc

SEQ ID NO: 49136 - DNA, 24 bp, Homo sapiens
cctcccctgcagacaacgtcaagg

SEQ ID NO: 49137 - DNA, 24 bp, Homo sapiens
gcctcccctgcagacaacgtcaag

SEQ ID NO: 49138 - DNA, 23 bp, Homo sapiens
gtggtggtggtggtggttggttg

SEQ ID NO: 49139 - DNA, 25 bp, Homo sapiens
catcattcagatcctacttgaaggc

SEQ ID NO: 49140 - DNA, 25 bp, Homo sapiens
tttgaagaagaggaaactatgaaga

SEQ ID NO: 49141 - DNA, 25 bp, Homo sapiens
aagattggctactacctggtgctgg

SEQ ID NO: 49142 - DNA, 24 bp, Homo sapiens
ctgcgtagccatctttgtgttcat

SEQ ID NO: 49143 - DNA, 23 bp, Homo sapiens
gcggtggctcatgcttgtaatcc

SEQ ID NO: 49144 - DNA, 24 bp, Homo sapiens
attccaaagaggtaaatgtaagat

SEQ ID NO: 49145 - DNA, 24 bp, Homo sapiens
gattccaaagaggtaaatgtaaga

SEQ ID NO: 49146 - DNA, 24 bp, Homo sapiens
tgattccaaagaggtaaatgtaag

SEQ ID NO: 49147 - DNA, 24 bp, Homo sapiens
gacctccaccaccaccaccctctc

SEQ ID NO: 49148 - DNA, 24 bp, Homo sapiens
ggtagggagtttcagactggcagc

SEQ ID NO: 49149 - DNA, 24 bp, Homo sapiens
ttggagtaaggggttgtctggagc

SEQ ID NO: 49150 - DNA, 24 bp, Homo sapiens
tgcaatcctggctgtgaatttcag

SEQ ID NO: 49151 - DNA, 24 bp, Homo sapiens
ctgcaatcctggctgtgaatttca

SEQ ID NO: 49152 - DNA, 24 bp, Homo sapiens
gctgcaatcctggctgtgaatttc

SEQ ID NO: 49153 - DNA, 24 bp, Homo sapiens
gcaccacctcaccaagatggctac

SEQ ID NO: 49154 - DNA, 23 bp, Homo sapiens
gggcgcttcgtgtgaggttccac

SEQ ID NO: 49155 - DNA, 23 bp, Homo sapiens
aggcgagaggcgcaggctgccac

SEQ ID NO: 49156 - DNA, 25 bp, Homo sapiens
gctaacatggacaactctgcacaga

SEQ ID NO: 49157 - DNA, 23 bp, Homo sapiens
acgcactggcaaacatcccagac

SEQ ID NO: 49158 - DNA, 23 bp, Homo sapiens
caaacaaatggaacacgtcacag

SEQ ID NO: 49159 - DNA, 24 bp, Homo sapiens
aaataaaccagctgcaagagaaat

SEQ ID NO: 49160 - DNA, 24 bp, Homo sapiens
gaaataaaccagctgcaagagaaa

SEQ ID NO: 49161 - DNA, 24 bp, Homo sapiens
ggaaataaaccagctgcaagagaa

SEQ ID NO: 49162 - DNA, 25 bp, Homo sapiens
aagcaatcctctcatcttagcctcc

SEQ ID NO: 49163 - DNA, 23 bp, Homo sapiens
gtgcagtggcgtgatctcagctc

SEQ ID NO: 49164 - DNA, 24 bp, Homo sapiens
aggcttacaggcgtgtactagcac

SEQ ID NO: 49165 - DNA, 25 bp, Homo sapiens
tggatcacttgaggtcaggagttcg

SEQ ID NO: 49166 - DNA, 25 bp, Homo sapiens
gcatggtagctcacgcctgtaatcc

SEQ ID NO: 49167 - DNA, 25 bp, Homo sapiens
actttagccattctttgagctgccg

SEQ ID NO: 49168 - DNA, 23 bp, Homo sapiens
gcagcagcagcactcggagatgc

SEQ ID NO: 49169 - DNA, 25 bp, Homo sapiens
agaaacggaacctggacctggagaa

SEQ ID NO: 49170 - DNA, 23 bp, Homo sapiens
ctctgtgggcgtccagtccttga

SEQ ID NO: 49171 - DNA, 24 bp, Homo sapiens
tactgttcaatgtaagctttgctg

SEQ ID NO: 49172 - DNA, 24 bp, Homo sapiens
ttactgttcaatgtaagctttgct

SEQ ID NO: 49173 - DNA, 24 bp, Homo sapiens
tttactgttcaatgtaagctttgc

SEQ ID NO: 49174 - DNA, 24 bp, Homo sapiens
accaagtcttgctctgttgccagg

SEQ ID NO: 49175 - DNA, 24 bp, Homo sapiens
gcttggtgccagagtgagagcaaa

SEQ ID NO: 49176 - DNA, 24 bp, Homo sapiens
ctgccttaaagctcagcctcactg

SEQ ID NO: 49177 - DNA, 24 bp, Homo sapiens
ctctggtaaaggcgactccgatgg

SEQ ID NO: 49178 - DNA, 24 bp, Homo sapiens
tctctggtaaaggcgactccgatg

SEQ ID NO: 49179 - DNA, 24 bp, Homo sapiens
ctctctggtaaaggcgactccgat

SEQ ID NO: 49180 - DNA, 24 bp, Homo sapiens
agaaagagtggaaattgaggcaaa

SEQ ID NO: 49181 - DNA, 24 bp, Homo sapiens
aagaaagagtggaaattgaggcaa

SEQ ID NO: 49182 - DNA, 24 bp, Homo sapiens
aaagaaagagtggaaattgaggca

SEQ ID NO: 49183 - DNA, 24 bp, Homo sapiens
atattagatgggctttttatggaa

SEQ ID NO: 49184 - DNA, 24 bp, Homo sapiens
aatattagatgggctttttatgga

SEQ ID NO: 49185 - DNA, 24 bp, Homo sapiens
taatattagatgggctttttatgg

SEQ ID NO: 49186 - DNA, 24 bp, Homo sapiens
ggaaacacctctacctcctgcgag

SEQ ID NO: 49187 - DNA, 24 bp, Homo sapiens
cgtgacttcagtaaagggaacccg

SEQ ID NO: 49188 - DNA, 23 bp, Homo sapiens
ccagcagcagcagcagcggcagc

SEQ ID NO: 49189 - DNA, 24 bp, Homo sapiens
ctgtctgtgctgctgccgctggta

SEQ ID NO: 49190 - DNA, 24 bp, Homo sapiens
cttcagctcgggtttccaggatgc

SEQ ID NO: 49191 - DNA, 24 bp, Homo sapiens
cctatcactggtatcgcaaggctt

SEQ ID NO: 49192 - DNA, 24 bp, Homo sapiens
gagacgggcgagcggctggtgctg

SEQ ID NO: 49193 - DNA, 24 bp, Homo sapiens
gtatggggtggtgtacgcgggccg

SEQ ID NO: 49194 - DNA, 24 bp, Homo sapiens
ggtgcgcatcgccatcaaggagat

SEQ ID NO: 49195 - DNA, 24 bp, Homo sapiens
acggccctcagggtgcccgaggag

SEQ ID NO: 49196 - DNA, 24 bp, Homo sapiens
cacggccctcagggtgcccgagga

SEQ ID NO: 49197 - DNA, 24 bp, Homo sapiens
ccacggccctcagggtgcccgagg

SEQ ID NO: 49198 - DNA, 24 bp, Homo sapiens
ttttcattcaggtgagtctttatg

SEQ ID NO: 49199 - DNA, 24 bp, Homo sapiens
cttttcattcaggtgagtctttat

SEQ ID NO: 49200 - DNA, 24 bp, Homo sapiens
ccttttcattcaggtgagtcttta

SEQ ID NO: 49201 - DNA, 25 bp, Homo sapiens
cagaatccctggttcagcctggaag

SEQ ID NO: 49202 - DNA, 25 bp, Homo sapiens
tctctagtcgccattggttacctaa

SEQ ID NO: 49203 - DNA, 23 bp, Homo sapiens
gggagtgaggagccgccaacacc

SEQ ID NO: 49204 - DNA, 24 bp, Homo sapiens
gagagccacatcagccagtccaac

SEQ ID NO: 49205 - DNA, 23 bp, Homo sapiens
gggacactagtgccaccgtctgc

SEQ ID NO: 49206 - DNA, 23 bp, Homo sapiens
ctccattctccagaagggactgc

SEQ ID NO: 49207 - DNA, 24 bp, Homo sapiens
gccctggagagcaaccacacgctg

SEQ ID NO: 49208 - DNA, 24 bp, Homo sapiens
ggccctggagagcaaccacacgct

SEQ ID NO: 49209 - DNA, 24 bp, Homo sapiens
gggccctggagagcaaccacacgc

SEQ ID NO: 49210 - DNA, 24 bp, Homo sapiens
acttgcggctgggctctgaagtgc

SEQ ID NO: 49211 - DNA, 24 bp, Homo sapiens
gacttgcggctgggctctgaagtg

SEQ ID NO: 49212 - DNA, 24 bp, Homo sapiens
ggacttgcggctgggctctgaagt

SEQ ID NO: 49213 - DNA, 23 bp, Homo sapiens
gacagcacagcagccaagggttc

SEQ ID NO: 49214 - DNA, 24 bp, Homo sapiens
ccacatggcacatagctgaagaga

SEQ ID NO: 49215 - DNA, 23 bp, Homo sapiens
tcccagcccagcctcccaagatg

SEQ ID NO: 49216 - DNA, 23 bp, Homo sapiens
tcccagcccagcctcccaagatg

SEQ ID NO: 49217 - DNA, 23 bp, Homo sapiens
ggaggaggctgaggctggagatg

SEQ ID NO: 49218 - DNA, 23 bp, Homo sapiens
tcacagcaagaccaagaggagcc

SEQ ID NO: 49219 - DNA, 23 bp, Homo sapiens
ggaggaggctgaggctggagatg

SEQ ID NO: 49220 - DNA, 24 bp, Homo sapiens
ctaggaatgccaagctacaggacc

SEQ ID NO: 49221 - DNA, 23 bp, Homo sapiens
tcccagcccagcctcccaagatg

SEQ ID NO: 49222 - DNA, 24 bp, Homo sapiens
atagatacctcatcctgtctacct

SEQ ID NO: 49223 - DNA, 24 bp, Homo sapiens
catagatacctcatcctgtctacc

SEQ ID NO: 49224 - DNA, 24 bp, Homo sapiens
gcatagatacctcatcctgtctac

SEQ ID NO: 49225 - DNA, 24 bp, Homo sapiens
tttccttttaggtacgaatttggt

SEQ ID NO: 49226 - DNA, 24 bp, Homo sapiens
ttttccttttaggtacgaatttgg

SEQ ID NO: 49227 - DNA, 24 bp, Homo sapiens
tttttccttttaggtacgaatttg

SEQ ID NO: 49228 - DNA, 24 bp, Homo sapiens
ggattcggaaccagatgcctgtga

SEQ ID NO: 49229 - DNA, 24 bp, Homo sapiens
tacaatttcctatcatgtaattgc

SEQ ID NO: 49230 - DNA, 24 bp, Homo sapiens
aaagcgatacagaaccaagaattt

SEQ ID NO: 49231 - DNA, 24 bp, Homo sapiens
caaagcgatacagaaccaagaatt

SEQ ID NO: 49232 - DNA, 24 bp, Homo sapiens
ccaaagcgatacagaaccaagaat

SEQ ID NO: 49233 - DNA, 24 bp, Homo sapiens
tttcaggatttacacattggtgga

SEQ ID NO: 49234 - DNA, 24 bp, Homo sapiens
atccatccattcatttactggtga

SEQ ID NO: 49235 - DNA, 24 bp, Homo sapiens
actagaaagacaatgtcttttgca

SEQ ID NO: 49236 - DNA, 24 bp, Homo sapiens
tgacgacgatgacgacgatacact

SEQ ID NO: 49237 - DNA, 24 bp, Homo sapiens
tgttacatttcctggagcactttg

SEQ ID NO: 49238 - DNA, 24 bp, Homo sapiens
tctctctatatctacctgggagcc

SEQ ID NO: 49239 - DNA, 24 bp, Homo sapiens
aaaggaaaaaggtaacattactgc

SEQ ID NO: 49240 - DNA, 24 bp, Homo sapiens
caaaggaaaaaggtaacattactg

SEQ ID NO: 49241 - DNA, 24 bp, Homo sapiens
ccaaaggaaaaaggtaacattact

SEQ ID NO: 49242 - DNA, 24 bp, Homo sapiens
gcctggattgtgctcagcggaatt

SEQ ID NO: 49243 - DNA, 24 bp, Homo sapiens
cctggtctccctgggtattgctgt

SEQ ID NO: 49244 - DNA, 24 bp, Homo sapiens
gcgttcccatttcacccaagacct

SEQ ID NO: 49245 - DNA, 24 bp, Homo sapiens
aaggagatggaggagcaggcagtt

SEQ ID NO: 49246 - DNA, 25 bp, Homo sapiens
ggtcaacacttacttccgccacttc

SEQ ID NO: 49247 - DNA, 24 bp, Homo sapiens
tggaggagtgctaccgctacttca

SEQ ID NO: 49248 - DNA, 23 bp, Homo sapiens
ggctctagcaggctccactaact

SEQ ID NO: 49249 - DNA, 23 bp, Homo sapiens
ggcagcacagcgactcggactcc

SEQ ID NO: 49250 - DNA, 23 bp, Homo sapiens
tactccacgctgccgccatccat

SEQ ID NO: 49251 - DNA, 24 bp, Homo sapiens
tgaaaagaaagataaggtgttact

SEQ ID NO: 49252 - DNA, 24 bp, Homo sapiens
atgaaaagaaagataaggtgttac

SEQ ID NO: 49253 - DNA, 24 bp, Homo sapiens
gatgaaaagaaagataaggtgtta

SEQ ID NO: 49254 - DNA, 24 bp, Homo sapiens
aagatcacaagaatactgaaaaat

SEQ ID NO: 49255 - DNA, 24 bp, Homo sapiens
caagatcacaagaatactgaaaaa

SEQ ID NO: 49256 - DNA, 24 bp, Homo sapiens
acaagatcacaagaatactgaaaa

SEQ ID NO: 49257 - DNA, 23 bp, Homo sapiens
acgtgctgcgtctcgacggacag

SEQ ID NO: 49258 - DNA, 23 bp, Homo sapiens
ggacggtgggtgccggagcagag

SEQ ID NO: 49259 - DNA, 23 bp, Homo sapiens
gtggtcctggcggtcctgcactt

SEQ ID NO: 49260 - DNA, 24 bp, Homo sapiens
ggttcacatttcctctgctgagaa

SEQ ID NO: 49261 - DNA, 24 bp, Homo sapiens
ctgggcgacagagcgagactccgt

SEQ ID NO: 49262 - DNA, 24 bp, Homo sapiens
acttctgagtagcatggcattaat

SEQ ID NO: 49263 - DNA, 25 bp, Homo sapiens
gcctcaccaacctttcgtcttccat

SEQ ID NO: 49264 - DNA, 25 bp, Homo sapiens
caatgtaatgtgacgctggaagtga

SEQ ID NO: 49265 - DNA, 23 bp, Homo sapiens
ctggctgggctggtcctcttgta

SEQ ID NO: 49266 - DNA, 23 bp, Homo sapiens
gagagtggctgagctgatcctgc

SEQ ID NO: 49267 - DNA, 23 bp, Homo sapiens
cgactggtgctgctggatgctgg

SEQ ID NO: 49268 - DNA, 23 bp, Homo sapiens
ggcggacatctgtgacactctgg

SEQ ID NO: 49269 - DNA, 24 bp, Homo sapiens
gcagaccttcaccctggaaacatc

SEQ ID NO: 49270 - DNA, 23 bp, Homo sapiens
ggcggacatctgtgacactctgg

SEQ ID NO: 49271 - DNA, 23 bp, Homo sapiens
cgactggtgctgctggatgctgg

SEQ ID NO: 49272 - DNA, 25 bp, Homo sapiens
aggaggagatggtgtcttagatgcc

SEQ ID NO: 49273 - DNA, 25 bp, Homo sapiens
gacaattcacggaactgttatcgga

SEQ ID NO: 49274 - DNA, 25 bp, Homo sapiens
aagaaggcgtgcgtgcaagttataa

SEQ ID NO: 49275 - DNA, 23 bp, Homo sapiens
gtactgggattacaggcgtgagc

SEQ ID NO: 49276 - DNA, 24 bp, Homo sapiens
agcctgctgaagtctcagtttctt

SEQ ID NO: 49277 - DNA, 25 bp, Homo sapiens
tgaaatgagaagttaggtttgatcc

SEQ ID NO: 49278 - DNA, 24 bp, Homo sapiens
cagactacaggcgtgtcgtcagtg

SEQ ID NO: 49279 - DNA, 24 bp, Homo sapiens
gcagtcccaggagccacccaccat

SEQ ID NO: 49280 - DNA, 24 bp, Homo sapiens
ggcagcacacacccctccctctgg

SEQ ID NO: 49281 - DNA, 24 bp, Homo sapiens
caggcacaggagcggaaggacata

SEQ ID NO: 49282 - DNA, 24 bp, Homo sapiens
tagaccatcacaggctcttcaccc

SEQ ID NO: 49283 - DNA, 24 bp, Homo sapiens
tgaccgcagttcacatccacatcc

SEQ ID NO: 49284 - DNA, 24 bp, Homo sapiens
tgcgttagtaacacacagccactg

SEQ ID NO: 49285 - DNA, 24 bp, Homo sapiens
aagggagccacaggtctaagcaac

SEQ ID NO: 49286 - DNA, 24 bp, Homo sapiens
aacactgcggagaggttcacaaca

SEQ ID NO: 49287 - DNA, 24 bp, Homo sapiens
ctattcattcttatatttttggag

SEQ ID NO: 49288 - DNA, 24 bp, Homo sapiens
cctattcattcttatatttttgga

SEQ ID NO: 49289 - DNA, 24 bp, Homo sapiens
ccctattcattcttatatttttgg

SEQ ID NO: 49290 - DNA, 24 bp, Homo sapiens
aagcagtcctcccacctcagtctc

SEQ ID NO: 49291 - DNA, 24 bp, Homo sapiens
agctgtgaggcaccacgcccagtc

SEQ ID NO: 49292 - DNA, 24 bp, Homo sapiens
ataaatatctgttcttgaactcct

SEQ ID NO: 49293 - DNA, 24 bp, Homo sapiens
aaagaaataaatttcttgacccaa

SEQ ID NO: 49294 - DNA, 24 bp, Homo sapiens
gaaagaaataaatttcttgaccca

SEQ ID NO: 49295 - DNA, 24 bp, Homo sapiens
cgaaagaaataaatttcttgaccc

SEQ ID NO: 49296 - DNA, 23 bp, Homo sapiens
ctggcggcgggcatcttcttcgt

SEQ ID NO: 49297 - DNA, 23 bp, Homo sapiens
ggcgtaagatggcgacagcagcg

SEQ ID NO: 49298 - DNA, 23 bp, Homo sapiens
gtgagctgggctgatctggaggg

SEQ ID NO: 49299 - DNA, 24 bp, Homo sapiens
tctacgtggtcagctatgaggcgg

SEQ ID NO: 49300 - DNA, 23 bp, Homo sapiens
tcaccacgcccggcttctcccat

SEQ ID NO: 49301 - DNA, 24 bp, Homo sapiens
ctactgtgtagcaatccacctgcc

SEQ ID NO: 49302 - DNA, 23 bp, Homo sapiens
tgggctggcggctgctgtctgag

SEQ ID NO: 49303 - DNA, 23 bp, Homo sapiens
ctcaaagctgctgctgcggctgg

SEQ ID NO: 49304 - DNA, 24 bp, Homo sapiens
agaatgagcaaaaaagaaaagaaa

SEQ ID NO: 49305 - DNA, 24 bp, Homo sapiens
aagaatgagcaaaaaagaaaagaa

SEQ ID NO: 49306 - DNA, 24 bp, Homo sapiens
aaagaatgagcaaaaaagaaaaga

SEQ ID NO: 49307 - DNA, 24 bp, Homo sapiens
gttttatttaggtttctcacactc

SEQ ID NO: 49308 - DNA, 24 bp, Homo sapiens
tgttttatttaggtttctcacact

SEQ ID NO: 49309 - DNA, 24 bp, Homo sapiens
ttgttttatttaggtttctcacac

SEQ ID NO: 49310 - DNA, 24 bp, Homo sapiens
aagtataaatgcacagccctcatg

SEQ ID NO: 49311 - DNA, 24 bp, Homo sapiens
taagtataaatgcacagccctcat

SEQ ID NO: 49312 - DNA, 24 bp, Homo sapiens
ataagtataaatgcacagccctca

SEQ ID NO: 49313 - DNA, 24 bp, Homo sapiens
gtaaagagtcagcagccacagccc

SEQ ID NO: 49314 - DNA, 24 bp, Homo sapiens
ccgagctgattacagacaccaagg

SEQ ID NO: 49315 - DNA, 24 bp, Homo sapiens
cctgtgggcatttattagtaaagt

SEQ ID NO: 49316 - DNA, 24 bp, Homo sapiens
catctgccttcgagcctgccactg

SEQ ID NO: 49317 - DNA, 24 bp, Homo sapiens
ttctgaaggctacctgcggaatga

SEQ ID NO: 49318 - DNA, 24 bp, Homo sapiens
aaggatgtgtgtttacccaaggct

SEQ ID NO: 49319 - DNA, 24 bp, Homo sapiens
tcaaagcagagcctcccgagaagc

SEQ ID NO: 49320 - DNA, 24 bp, Homo sapiens
agccttggaattgaagaatgaaca

SEQ ID NO: 49321 - DNA, 24 bp, Homo sapiens
tgggattctgagagtctctgtgag

SEQ ID NO: 49322 - DNA, 24 bp, Homo sapiens
aagataaccacgcctccatctgcc

SEQ ID NO: 49323 - DNA, 24 bp, Homo sapiens
aaagataaccacgcctccatctgc

SEQ ID NO: 49324 - DNA, 24 bp, Homo sapiens
taaagataaccacgcctccatctg

SEQ ID NO: 49325 - DNA, 24 bp, Homo sapiens
caagcggcggcggatgaactggat

SEQ ID NO: 49326 - DNA, 24 bp, Homo sapiens
tgcccaaagaggagaccaggaaga

SEQ ID NO: 49327 - DNA, 24 bp, Homo sapiens
gctgctctcatcctcggaaaccaa

SEQ ID NO: 49328 - DNA, 24 bp, Homo sapiens
ggtggacggcaacatgaagaagcg

SEQ ID NO: 49329 - DNA, 24 bp, Homo sapiens
aaccacggacagaccaggcacatg

SEQ ID NO: 49330 - DNA, 24 bp, Homo sapiens
caagcggcggcggatgaactggat

SEQ ID NO: 49331 - DNA, 24 bp, Homo sapiens
cctcctgctcaacgggaagtccta

SEQ ID NO: 49332 - DNA, 24 bp, Homo sapiens
caagcggcggcggatgaactggat

SEQ ID NO: 49333 - DNA, 24 bp, Homo sapiens
tgcccaaagaggagaccaggaaga

SEQ ID NO: 49334 - DNA, 24 bp, Homo sapiens
cagtcaagcggcggcggatgaact

SEQ ID NO: 49335 - DNA, 24 bp, Homo sapiens
gaagtcctaccccaccaaagtgcg

SEQ ID NO: 49336 - DNA, 24 bp, Homo sapiens
cgccccgggtgacgtgttctacat

SEQ ID NO: 49337 - DNA, 24 bp, Homo sapiens
agtgccacagcgaacgaatgacct

SEQ ID NO: 49338 - DNA, 24 bp, Homo sapiens
aagtgccacagcgaacgaatgacc

SEQ ID NO: 49339 - DNA, 24 bp, Homo sapiens
gaagtgccacagcgaacgaatgac

SEQ ID NO: 49340 - DNA, 24 bp, Homo sapiens
gggagcatggtcttgggagtggta

SEQ ID NO: 49341 - DNA, 25 bp, Homo sapiens
aagaagcccaaggatagcacaaccc

SEQ ID NO: 49342 - DNA, 23 bp, Homo sapiens
ttggatcaggacggacgcttgga

SEQ ID NO: 49343 - DNA, 24 bp, Homo sapiens
ggattacaggtgtcagccactaca

SEQ ID NO: 49344 - DNA, 24 bp, Homo sapiens
aggctagtcttgaactcctgatcg

SEQ ID NO: 49345 - DNA, 25 bp, Homo sapiens
attgagtaaactatgaatgctggaa

SEQ ID NO: 49346 - DNA, 23 bp, Homo sapiens
cactggtggtcaaggctgggaag

SEQ ID NO: 49347 - DNA, 23 bp, Homo sapiens
gaggtggtgggcagcagtgacag

SEQ ID NO: 49348 - DNA, 23 bp, Homo sapiens
agtacagcgtgacactgaggagt

SEQ ID NO: 49349 - DNA, 23 bp, Homo sapiens
cagaggtggcggctggagtgcgg

SEQ ID NO: 49350 - DNA, 23 bp, Homo sapiens
gggcggaatcctggagagatggg

SEQ ID NO: 49351 - DNA, 23 bp, Homo sapiens
tccaaggtggggcggggtcggat

SEQ ID NO: 49352 - DNA, 24 bp, Homo sapiens
gcagcaggcaggaccagtatcaag

SEQ ID NO: 49353 - DNA, 24 bp, Homo sapiens
aacagttcctctgggcagtttgag

SEQ ID NO: 49354 - DNA, 25 bp, Homo sapiens
ttctatccagagtgccaaccagagc

SEQ ID NO: 49355 - DNA, 25 bp, Homo sapiens
tgtaactgtagtgcctgagaatgcc

SEQ ID NO: 49356 - DNA, 25 bp, Homo sapiens
ctgtagatgtggaactgctcctggt

SEQ ID NO: 49357 - DNA, 23 bp, Homo sapiens
aaagatggtggcagtgggcagac

SEQ ID NO: 49358 - DNA, 24 bp, Homo sapiens
ggggaacacaggcagcagccacat

SEQ ID NO: 49359 - DNA, 24 bp, Homo sapiens
tggggaacacaggcagcagccaca

SEQ ID NO: 49360 - DNA, 24 bp, Homo sapiens
ctggggaacacaggcagcagccac

SEQ ID NO: 49361 - DNA, 24 bp, Homo sapiens
gggctttcgttgttactggtggat

SEQ ID NO: 49362 - DNA, 24 bp, Homo sapiens
ccaagtggctgctgtggtaactac

SEQ ID NO: 49363 - DNA, 24 bp, Homo sapiens
ccgttctgggatgggactgacttt

SEQ ID NO: 49364 - DNA, 25 bp, Homo sapiens
cggtcagcgagatcctgttcaatga

SEQ ID NO: 49365 - DNA, 24 bp, Homo sapiens
gccaccagcaccatcaacctctac

SEQ ID NO: 49366 - DNA, 23 bp, Homo sapiens
cactgctcacctgtctgtcgtcg

SEQ ID NO: 49367 - DNA, 24 bp, Homo sapiens
cttaattctaggaaaacagacagt

SEQ ID NO: 49368 - DNA, 24 bp, Homo sapiens
tcttaattctaggaaaacagacag

SEQ ID NO: 49369 - DNA, 24 bp, Homo sapiens
ttcttaattctaggaaaacagaca

SEQ ID NO: 49370 - DNA, 24 bp, Homo sapiens
ggctgggcgtggtcacctttttct

SEQ ID NO: 49371 - DNA, 24 bp, Homo sapiens
tggctgggcgtggtcacctttttc

SEQ ID NO: 49372 - DNA, 24 bp, Homo sapiens
ttggctgggcgtggtcaccttttt

SEQ ID NO: 49373 - DNA, 24 bp, Homo sapiens
tataacctctggagaagtgtttga

SEQ ID NO: 49374 - DNA, 24 bp, Homo sapiens
atataacctctggagaagtgtttg

SEQ ID NO: 49375 - DNA, 24 bp, Homo sapiens
aatataacctctggagaagtgttt

SEQ ID NO: 49376 - DNA, 23 bp, Homo sapiens
ccttctggctggtgcgatggctg

SEQ ID NO: 49377 - DNA, 24 bp, Homo sapiens
gctcactgccctcacctaccacta

SEQ ID NO: 49378 - DNA, 24 bp, Homo sapiens
tcctaattgagatcgctgtgccgc

SEQ ID NO: 49379 - DNA, 24 bp, Homo sapiens
aaagagagaagcatatatttccag

SEQ ID NO: 49380 - DNA, 24 bp, Homo sapiens
aaaagagagaagcatatatttcca

SEQ ID NO: 49381 - DNA, 24 bp, Homo sapiens
gaaaagagagaagcatatatttcc

SEQ ID NO: 49382 - DNA, 23 bp, Homo sapiens
cctaaagctgctcctggatgccc

SEQ ID NO: 49383 - DNA, 23 bp, Homo sapiens
gaggaacagccaggaccccatct

SEQ ID NO: 49384 - DNA, 24 bp, Homo sapiens
aggcttctggcagcttccatccta

SEQ ID NO: 49385 - DNA, 24 bp, Homo sapiens
cccaagaagcccagataatccagg

SEQ ID NO: 49386 - DNA, 23 bp, Homo sapiens
ctaagcagcagccccagcccagc

SEQ ID NO: 49387 - DNA, 25 bp, Homo sapiens
agagaatgtcaagacgaagtagccg

SEQ ID NO: 49388 - DNA, 24 bp, Homo sapiens
taatatgcaagagctggtactcaa

SEQ ID NO: 49389 - DNA, 24 bp, Homo sapiens
ttaatatgcaagagctggtactca

SEQ ID NO: 49390 - DNA, 24 bp, Homo sapiens
tttaatatgcaagagctggtactc

SEQ ID NO: 49391 - DNA, 24 bp, Homo sapiens
catggccccagacggcaacggggg

SEQ ID NO: 49392 - DNA, 24 bp, Homo sapiens
ccatggccccagacggcaacgggg

SEQ ID NO: 49393 - DNA, 24 bp, Homo sapiens
gccatggccccagacggcaacggg

SEQ ID NO: 49394 - DNA, 24 bp, Homo sapiens
caggacccctgctttgctgtctgc

SEQ ID NO: 49395 - DNA, 24 bp, Homo sapiens
ccaggacccctgctttgctgtctg

SEQ ID NO: 49396 - DNA, 24 bp, Homo sapiens
gccaggacccctgctttgctgtct

SEQ ID NO: 49397 - DNA, 24 bp, Homo sapiens
ggtggtggtgtctggttagctcgg

SEQ ID NO: 49398 - DNA, 24 bp, Homo sapiens
gctcggcgatggtaggcgtccctg

SEQ ID NO: 49399 - DNA, 24 bp, Homo sapiens
ccgtgtcgcgggtagaggcgggcg

SEQ ID NO: 49400 - DNA, 24 bp, Homo sapiens
aattaaagaatttcaagtccctaa

SEQ ID NO: 49401 - DNA, 24 bp, Homo sapiens
gcctcccaaagtgccaggattaca

SEQ ID NO: 49402 - DNA, 24 bp, Homo sapiens
gtttcacacagaagtcacgagggc

SEQ ID NO: 49403 - DNA, 24 bp, Homo sapiens
ggtcaggaggaggagcaccattgg

SEQ ID NO: 49404 - DNA, 25 bp, Homo sapiens
acaaggatctccgttacaagctcat

SEQ ID NO: 49405 - DNA, 23 bp, Homo sapiens
gcagcagcagcactcggagatgc

SEQ ID NO: 49406 - DNA, 25 bp, Homo sapiens
aacctggacctggagaagagcctac

SEQ ID NO: 49407 - DNA, 24 bp, Homo sapiens
ggagatgcaagggaaaattaagct

SEQ ID NO: 49408 - DNA, 24 bp, Homo sapiens
aggagatgcaagggaaaattaagc

SEQ ID NO: 49409 - DNA, 24 bp, Homo sapiens
caggagatgcaagggaaaattaag

SEQ ID NO: 49410 - DNA, 24 bp, Homo sapiens
tgtattttaagggaaaattaagct

SEQ ID NO: 49411 - DNA, 24 bp, Homo sapiens
ctgtattttaagggaaaattaagc

SEQ ID NO: 49412 - DNA, 24 bp, Homo sapiens
tctgtattttaagggaaaattaag

SEQ ID NO: 49413 - DNA, 24 bp, Homo sapiens
aagtgatcctcccacctcagcctc

SEQ ID NO: 49414 - DNA, 24 bp, Homo sapiens
cacccaggctggagtgcagcagca

SEQ ID NO: 49415 - DNA, 24 bp, Homo sapiens
cggctcactgcagcctccacctcc

SEQ ID NO: 49416 - DNA, 23 bp, Homo sapiens
cagatcagcagcgtcaaggaccg

SEQ ID NO: 49417 - DNA, 23 bp, Homo sapiens
gccttcctcacctgcctgctgta

SEQ ID NO: 49418 - DNA, 25 bp, Homo sapiens
ggaggagttctgcatctacaaccgc

SEQ ID NO: 49419 - DNA, 24 bp, Homo sapiens
cccaaggcggagcccatgccctcg

SEQ ID NO: 49420 - DNA, 24 bp, Homo sapiens
tcctcagcgccccccgccagcagc

SEQ ID NO: 49421 - DNA, 23 bp, Homo sapiens
gccttcactgcgtcctctgctgg

SEQ ID NO: 49422 - DNA, 25 bp, Homo sapiens
ttcttcacatacctcctgcctcaca

SEQ ID NO: 49423 - DNA, 25 bp, Homo sapiens
cgagaagcggaacctctataatgcc

SEQ ID NO: 49424 - DNA, 24 bp, Homo sapiens
atttttaatagaaatccatacttg

SEQ ID NO: 49425 - DNA, 24 bp, Homo sapiens
tatttttaatagaaatccatactt

SEQ ID NO: 49426 - DNA, 24 bp, Homo sapiens
atatttttaatagaaatccatact

SEQ ID NO: 49427 - DNA, 24 bp, Homo sapiens
cacactggctcatgcctgcaatcc

SEQ ID NO: 49428 - DNA, 24 bp, Homo sapiens
ttttttctgggaaagtaataaggg

SEQ ID NO: 49429 - DNA, 24 bp, Homo sapiens
tggttctagaatgaaaaacatttg

SEQ ID NO: 49430 - DNA, 24 bp, Homo sapiens
ttggactttcggcttgattcgggc

SEQ ID NO: 49431 - DNA, 24 bp, Homo sapiens
tcctgacctcgtgatccacctgtg

SEQ ID NO: 49432 - DNA, 24 bp, Homo sapiens
cgcttggctgattgtattttcttt

SEQ ID NO: 49433 - DNA, 24 bp, Homo sapiens
gcacactcgcacaccgcacctcag

SEQ ID NO: 49434 - DNA, 24 bp, Homo sapiens
tgccccgaggaaacccgagccgcg

SEQ ID NO: 49435 - DNA, 24 bp, Homo sapiens
tgggtaacaacttctccagtatcc

SEQ ID NO: 49436 - DNA, 23 bp, Homo sapiens
ccgcttctaccgctcacctgagg

SEQ ID NO: 49437 - DNA, 23 bp, Homo sapiens
gtggtccctgggctgcatccttg

SEQ ID NO: 49438 - DNA, 23 bp, Homo sapiens
tgggcacaccctacgacctggcc

SEQ ID NO: 49439 - DNA, 24 bp, Homo sapiens
tgatcactcaggcttgcaaagatt

SEQ ID NO: 49440 - DNA, 24 bp, Homo sapiens
atgatcactcaggcttgcaaagat

SEQ ID NO: 49441 - DNA, 24 bp, Homo sapiens
aatgatcactcaggcttgcaaaga

SEQ ID NO: 49442 - DNA, 23 bp, Homo sapiens
gctccatccgaatgtgtctgccc

SEQ ID NO: 49443 - DNA, 25 bp, Homo sapiens
ggagaagttggacggactagcgaag

SEQ ID NO: 49444 - DNA, 23 bp, Homo sapiens
ctgcctgcctgctgctgggtgtc

SEQ ID NO: 49445 - DNA, 23 bp, Homo sapiens
tggaaagaagggcgacgatggga

SEQ ID NO: 49446 - DNA, 23 bp, Homo sapiens
gggagagaacggtgtggacggtg

SEQ ID NO: 49447 - DNA, 23 bp, Homo sapiens
caagggcgagcagggagacacag

SEQ ID NO: 49448 - DNA, 23 bp, Homo sapiens
ggtcattagtcttccgcttccta

SEQ ID NO: 49449 - DNA, 25 bp, Homo sapiens
aaatgctgacttgtgtcgtttgccc

SEQ ID NO: 49450 - DNA, 23 bp, Homo sapiens
gcaagcacagcagcacccagagg

SEQ ID NO: 49451 - DNA, 24 bp, Homo sapiens
tatacttacagatgtctagagttt

SEQ ID NO: 49452 - DNA, 24 bp, Homo sapiens
ttatacttacagatgtctagagtt

SEQ ID NO: 49453 - DNA, 24 bp, Homo sapiens
tttatacttacagatgtctagagt

SEQ ID NO: 49454 - DNA, 24 bp, Homo sapiens
agtggatttctgtgagagctgaaa

SEQ ID NO: 49455 - DNA, 24 bp, Homo sapiens
cagtggatttctgtgagagctgaa

SEQ ID NO: 49456 - DNA, 24 bp, Homo sapiens
acagtggatttctgtgagagctga

SEQ ID NO: 49457 - DNA, 25 bp, Homo sapiens
ccatgtgctgagaagtcaaggttgc

SEQ ID NO: 49458 - DNA, 23 bp, Homo sapiens
gagttggaggccagcctgtgcaa

SEQ ID NO: 49459 - DNA, 23 bp, Homo sapiens
gggtggtggcgcacgcctgtaat

SEQ ID NO: 49460 - DNA, 23 bp, Homo sapiens
gcctgagcaactggtgtccttcg

SEQ ID NO: 49461 - DNA, 23 bp, Homo sapiens
cctggtcctgtggctgtctctgg

SEQ ID NO: 49462 - DNA, 25 bp, Homo sapiens
actcctcgtcatcagaacagaacca

SEQ ID NO: 49463 - DNA, 24 bp, Homo sapiens
agaggcaaaagggagttcctgaca

SEQ ID NO: 49464 - DNA, 24 bp, Homo sapiens
aagaggcaaaagggagttcctgac

SEQ ID NO: 49465 - DNA, 24 bp, Homo sapiens
gaagaggcaaaagggagttcctga

SEQ ID NO: 49466 - DNA, 25 bp, Homo sapiens
gacacccagccctatacctacaagc

SEQ ID NO: 49467 - DNA, 23 bp, Homo sapiens
gttgcctacacgcctgctgagac

SEQ ID NO: 49468 - DNA, 23 bp, Homo sapiens
gggaaataatgcctgcctcacag

SEQ ID NO: 49469 - DNA, 25 bp, Homo sapiens
gcctccagtgaactgtagactcctg

SEQ ID NO: 49470 - DNA, 23 bp, Homo sapiens
gggcaagggagtatttgtgacac

SEQ ID NO: 49471 - DNA, 24 bp, Homo sapiens
agtctcactctttgacccaggctg

SEQ ID NO: 49472 - DNA, 24 bp, Homo sapiens
cggttggccaggctggaatgcaat

SEQ ID NO: 49473 - DNA, 24 bp, Homo sapiens
ccggttggccaggctggaatgcaa

SEQ ID NO: 49474 - DNA, 24 bp, Homo sapiens
accggttggccaggctggaatgca

SEQ ID NO: 49475 - DNA, 24 bp, Homo sapiens
ctcgggagacctctgctaccttgg

SEQ ID NO: 49476 - DNA, 24 bp, Homo sapiens
tggactggagtgagaatgccgtga

SEQ ID NO: 49477 - DNA, 24 bp, Homo sapiens
ccttcctgtggcaaatggtccagc

SEQ ID NO: 49478 - DNA, 24 bp, Homo sapiens
accactgttcactccttcactacg

SEQ ID NO: 49479 - DNA, 24 bp, Homo sapiens
atggaggcagtctgctaattcagg

SEQ ID NO: 49480 - DNA, 24 bp, Homo sapiens
aaaccggcaacggggagattgtga

SEQ ID NO: 49481 - DNA, 24 bp, Homo sapiens
aactcaatccagcacttacactct

SEQ ID NO: 49482 - DNA, 24 bp, Homo sapiens
gccaacagccacagcacaggacaa

SEQ ID NO: 49483 - DNA, 24 bp, Homo sapiens
agcgtgttgaatcctcagtgtact

SEQ ID NO: 49484 - DNA, 23 bp, Homo sapiens
atggtcaccttccgaactggacg

SEQ ID NO: 49485 - DNA, 24 bp, Homo sapiens
gcttgtatgaagtggagatggcag

SEQ ID NO: 49486 - DNA, 23 bp, Homo sapiens
cattccagccaaccagcaccgcc

SEQ ID NO: 49487 - DNA, 24 bp, Homo sapiens
gcttgactgaagaccttgccacaa

SEQ ID NO: 49488 - DNA, 24 bp, Homo sapiens
ctgcaaggtatgaacgaagtctga

SEQ ID NO: 49489 - DNA, 24 bp, Homo sapiens
aacacttgtaagttctcacttcat

SEQ ID NO: 49490 - DNA, 23 bp, Homo sapiens
ccgcaaaggcagtctcagcattg

SEQ ID NO: 49491 - DNA, 23 bp, Homo sapiens
cctgaactccatctcctccgtga

SEQ ID NO: 49492 - DNA, 24 bp, Homo sapiens
ggtggaggtgagcatggagtacga

SEQ ID NO: 49493 - DNA, 24 bp, Homo sapiens
ttgtcttttagtatctagcagata

SEQ ID NO: 49494 - DNA, 24 bp, Homo sapiens
attgtcttttagtatctagcagat

SEQ ID NO: 49495 - DNA, 24 bp, Homo sapiens
tattgtcttttagtatctagcaga

SEQ ID NO: 49496 - DNA, 24 bp, Homo sapiens
aaagaaccccacaattcctctgaa

SEQ ID NO: 49497 - DNA, 24 bp, Homo sapiens
taaagaaccccacaattcctctga

SEQ ID NO: 49498 - DNA, 24 bp, Homo sapiens
ataaagaaccccacaattcctctg

SEQ ID NO: 49499 - DNA, 24 bp, Homo sapiens
ttcagcagatgatggaggacaagc

SEQ ID NO: 49500 - DNA, 24 bp, Homo sapiens
ctgagatcctggtgcggctgcgat

SEQ ID NO: 49501 - DNA, 24 bp, Homo sapiens
ccgtctgggagaggatgtctgtga

SEQ ID NO: 49502 - DNA, 24 bp, Homo sapiens
tcttcctgaactctgtcacggagg

SEQ ID NO: 49503 - DNA, 24 bp, Homo sapiens
caggcaggcagtacctcggcgtga

SEQ ID NO: 49504 - DNA, 24 bp, Homo sapiens
ggagagagcttcacgcacaccatc

SEQ ID NO: 49505 - DNA, 24 bp, Homo sapiens
cgccttcctgtttgtcagagatgc

SEQ ID NO: 49506 - DNA, 24 bp, Homo sapiens
gaagccgcccaacaccaccactga

SEQ ID NO: 49507 - DNA, 24 bp, Homo sapiens
tggaccgatgtgaagtaggaacga

SEQ ID NO: 49508 - DNA, 24 bp, Homo sapiens
gaagccgcccaacaccaccactga

SEQ ID NO: 49509 - DNA, 24 bp, Homo sapiens
cgccttcctgtttgtcagagatgc

SEQ ID NO: 49510 - DNA, 24 bp, Homo sapiens
gcgatgacttgctgttgaaagagt

SEQ ID NO: 49511 - DNA, 24 bp, Homo sapiens
gaaaaatccaattgatcatcatag

SEQ ID NO: 49512 - DNA, 24 bp, Homo sapiens
ggaaaaatccaattgatcatcata

SEQ ID NO: 49513 - DNA, 24 bp, Homo sapiens
aggaaaaatccaattgatcatcat

SEQ ID NO: 49514 - DNA, 24 bp, Homo sapiens
tgagaaaaagggatcaaaaggaaa

SEQ ID NO: 49515 - DNA, 24 bp, Homo sapiens
atgagaaaaagggatcaaaaggaa

SEQ ID NO: 49516 - DNA, 24 bp, Homo sapiens
aatgagaaaaagggatcaaaagga

SEQ ID NO: 49517 - DNA, 23 bp, Homo sapiens
ggttcaccaccttgatgctgtgt

SEQ ID NO: 49518 - DNA, 23 bp, Homo sapiens
gtggtggtggtctcctggcagag

SEQ ID NO: 49519 - DNA, 23 bp, Homo sapiens
gccgagctggagttagaggtgga

SEQ ID NO: 49520 - DNA, 24 bp, Homo sapiens
acagcctccaccttccagttcctt

SEQ ID NO: 49521 - DNA, 24 bp, Homo sapiens
cgccagaggtgatacggaatgaac

SEQ ID NO: 49522 - DNA, 24 bp, Homo sapiens
agatgtcatttgctggcacggtcg

SEQ ID NO: 49523 - DNA, 25 bp, Homo sapiens
acggaggaagacaatcaactggtgc

SEQ ID NO: 49524 - DNA, 25 bp, Homo sapiens
atcattggtctggaaggtgtggagc

SEQ ID NO: 49525 - DNA, 23 bp, Homo sapiens
agttccgtaacctgagccaccgc

SEQ ID NO: 49526 - DNA, 24 bp, Homo sapiens
ttcagtttaatgtggtgatgcgca

SEQ ID NO: 49527 - DNA, 24 bp, Homo sapiens
attcagtttaatgtggtgatgcgc

SEQ ID NO: 49528 - DNA, 24 bp, Homo sapiens
gattcagtttaatgtggtgatgcg

SEQ ID NO: 49529 - DNA, 24 bp, Homo sapiens
gagaataaaaggtaaaaaaaagaa

SEQ ID NO: 49530 - DNA, 24 bp, Homo sapiens
ggagaataaaaggtaaaaaaaaga

SEQ ID NO: 49531 - DNA, 24 bp, Homo sapiens
aggagaataaaaggtaaaaaaaag

SEQ ID NO: 49532 - DNA, 24 bp, Homo sapiens
gaaaatggaagaaacatttctatg

SEQ ID NO: 49533 - DNA, 24 bp, Homo sapiens
agaaaatggaagaaacatttctat

SEQ ID NO: 49534 - DNA, 24 bp, Homo sapiens
aagaaaatggaagaaacatttcta

SEQ ID NO: 49535 - DNA, 24 bp, Homo sapiens
atggcctacaggcagctgtggccc

SEQ ID NO: 49536 - DNA, 24 bp, Homo sapiens
catggcctacaggcagctgtggcc

SEQ ID NO: 49537 - DNA, 24 bp, Homo sapiens
acatggcctacaggcagctgtggc

SEQ ID NO: 49538 - DNA, 24 bp, Homo sapiens
accccccacagcccagccgaggca

SEQ ID NO: 49539 - DNA, 24 bp, Homo sapiens
aaccccccacagcccagccgaggc

SEQ ID NO: 49540 - DNA, 24 bp, Homo sapiens
caaccccccacagcccagccgagg

SEQ ID NO: 49541 - DNA, 24 bp, Homo sapiens
gtgggtcaagtccgaatcaggcag

SEQ ID NO: 49542 - DNA, 24 bp, Homo sapiens
ttgactgtctctccttcctcgggc

SEQ ID NO: 49543 - DNA, 24 bp, Homo sapiens
gagtggaggctgggacagatggtg

SEQ ID NO: 49544 - DNA, 24 bp, Homo sapiens
accatcaaaagataccagcagttt

SEQ ID NO: 49545 - DNA, 24 bp, Homo sapiens
caccatcaaaagataccagcagtt

SEQ ID NO: 49546 - DNA, 24 bp, Homo sapiens
ccaccatcaaaagataccagcagt

SEQ ID NO: 49547 - DNA, 23 bp, Homo sapiens
gtctggtgagtagctgggactac

SEQ ID NO: 49548 - DNA, 23 bp, Homo sapiens
ctgaggtttcatttcttacatat

SEQ ID NO: 49549 - DNA, 23 bp, Homo sapiens
tttttgatactgctgagatttat

SEQ ID NO: 49550 - DNA, 24 bp, Homo sapiens
agcctgaaaaggtatataccctct

SEQ ID NO: 49551 - DNA, 24 bp, Homo sapiens
cagcctgaaaaggtatataccctc

SEQ ID NO: 49552 - DNA, 24 bp, Homo sapiens
tcagcctgaaaaggtatataccct

SEQ ID NO: 49553 - DNA, 24 bp, Homo sapiens
tcttacataagcatctggctatta

SEQ ID NO: 49554 - DNA, 24 bp, Homo sapiens
ttcttacataagcatctggctatt

SEQ ID NO: 49555 - DNA, 24 bp, Homo sapiens
cttcttacataagcatctggctat

SEQ ID NO: 49556 - DNA, 25 bp, Homo sapiens
caaggtggaactcctgcggataagc

SEQ ID NO: 49557 - DNA, 25 bp, Homo sapiens
gagaatggcacaacagttggcaagt

SEQ ID NO: 49558 - DNA, 25 bp, Homo sapiens
gtaaggctgtggcagggtacaagtg

SEQ ID NO: 49559 - DNA, 23 bp, Homo sapiens
gacactgaagccgcagccacaac

SEQ ID NO: 49560 - DNA, 24 bp, Homo sapiens
gggtgttacagcagcaagggtctc

SEQ ID NO: 49561 - DNA, 25 bp, Homo sapiens
acattatgctgacattcaagtgtgc

SEQ ID NO: 49562 - DNA, 23 bp, Homo sapiens
gttacccgtcctggcgtttctgg

SEQ ID NO: 49563 - DNA, 23 bp, Homo sapiens
ctctcgcaggctcgctcgcttct

SEQ ID NO: 49564 - DNA, 24 bp, Homo sapiens
cgtgaaggagtggatcaatgcggc

SEQ ID NO: 49565 - DNA, 25 bp, Homo sapiens
aatggaatcaagactgtggagacgc

SEQ ID NO: 49566 - DNA, 23 bp, Homo sapiens
atcgccgtccacattgctcacag

SEQ ID NO: 49567 - DNA, 25 bp, Homo sapiens
gatagcgggactcgttgacattggg

SEQ ID NO: 49568 - DNA, 24 bp, Homo sapiens
gagccagagcctggaccagaactt

SEQ ID NO: 49569 - DNA, 24 bp, Homo sapiens
cgccgcagccgcctcgccgccacc

SEQ ID NO: 49570 - DNA, 24 bp, Homo sapiens
cggccgccagtggtcctcggactt

SEQ ID NO: 49571 - DNA, 24 bp, Homo sapiens
ctgtttaattgatccagaatgaag

SEQ ID NO: 49572 - DNA, 24 bp, Homo sapiens
actgtttaattgatccagaatgaa

SEQ ID NO: 49573 - DNA, 24 bp, Homo sapiens
cactgtttaattgatccagaatga

SEQ ID NO: 49574 - DNA, 24 bp, Homo sapiens
ctgccatgtgtaagccactgatgc

SEQ ID NO: 49575 - DNA, 23 bp, Homo sapiens
ctcccactgctcccacccctcca

SEQ ID NO: 49576 - DNA, 23 bp, Homo sapiens
ctcctgcaaggtggagatgaagt

SEQ ID NO: 49577 - DNA, 24 bp, Homo sapiens
ggttcaagcgattctcctgcctca

SEQ ID NO: 49578 - DNA, 24 bp, Homo sapiens
ccaaccagcagtgttcaggaggat

SEQ ID NO: 49579 - DNA, 24 bp, Homo sapiens
ttggcaacgctggtctcaaactcg

SEQ ID NO: 49580 - DNA, 24 bp, Homo sapiens
attatacaagagtgagtatgtaaa

SEQ ID NO: 49581 - DNA, 24 bp, Homo sapiens
aattatacaagagtgagtatgtaa

SEQ ID NO: 49582 - DNA, 24 bp, Homo sapiens
aaattatacaagagtgagtatgta

SEQ ID NO: 49583 - DNA, 24 bp, Homo sapiens
cctctttgtagataattcatcacc

SEQ ID NO: 49584 - DNA, 24 bp, Homo sapiens
tcctctttgtagataattcatcac

SEQ ID NO: 49585 - DNA, 24 bp, Homo sapiens
ttcctctttgtagataattcatca

SEQ ID NO: 49586 - DNA, 24 bp, Homo sapiens
acttattgcagattcatagaaaac

SEQ ID NO: 49587 - DNA, 24 bp, Homo sapiens
aacttattgcagattcatagaaaa

SEQ ID NO: 49588 - DNA, 24 bp, Homo sapiens
taacttattgcagattcatagaaa

SEQ ID NO: 49589 - DNA, 23 bp, Homo sapiens
gacgacctgtgctatgagttccg

SEQ ID NO: 49590 - DNA, 23 bp, Homo sapiens
actgtccaccgcacccacctgta

SEQ ID NO: 49591 - DNA, 23 bp, Homo sapiens
gcagttcctccgctacgcacagg

SEQ ID NO: 49592 - DNA, 25 bp, Homo sapiens
gggattagggattgccacttctgag

SEQ ID NO: 49593 - DNA, 24 bp, Homo sapiens
gctgcctcgttgagtcttctctgc

SEQ ID NO: 49594 - DNA, 25 bp, Homo sapiens
aggacttcatgctccggacagagaa

SEQ ID NO: 49595 - DNA, 24 bp, Homo sapiens
agcagttcaaggtaatagtttatt

SEQ ID NO: 49596 - DNA, 24 bp, Homo sapiens
aagcagttcaaggtaatagtttat

SEQ ID NO: 49597 - DNA, 24 bp, Homo sapiens
caagcagttcaaggtaatagttta

SEQ ID NO: 49598 - DNA, 24 bp, Homo sapiens
tagtaatgccagggagtttgaaga

SEQ ID NO: 49599 - DNA, 24 bp, Homo sapiens
atagtaatgccagggagtttgaag

SEQ ID NO: 49600 - DNA, 24 bp, Homo sapiens
gatagtaatgccagggagtttgaa

SEQ ID NO: 49601 - DNA, 24 bp, Homo sapiens
gtggtggcccgagctgtgggaacc

SEQ ID NO: 49602 - DNA, 24 bp, Homo sapiens
tgtggtggcccgagctgtgggaac

SEQ ID NO: 49603 - DNA, 24 bp, Homo sapiens
ttgtggtggcccgagctgtgggaa

SEQ ID NO: 49604 - DNA, 24 bp, Homo sapiens
acagccagcagccaagcgtcagaa

SEQ ID NO: 49605 - DNA, 24 bp, Homo sapiens
ctacggaaggctctgacccatctg

SEQ ID NO: 49606 - DNA, 24 bp, Homo sapiens
cctgccagcaccaatgagcctatt

SEQ ID NO: 49607 - DNA, 23 bp, Homo sapiens
cttgagcagcagcagcagcagca

SEQ ID NO: 49608 - DNA, 23 bp, Homo sapiens
aacccggttctagaagccaaacg

SEQ ID NO: 49609 - DNA, 25 bp, Homo sapiens
tgaactagaactgcctgctggttgg

SEQ ID NO: 49610 - DNA, 23 bp, Homo sapiens
agcagcaacagcagcagcaacag

SEQ ID NO: 49611 - DNA, 23 bp, Homo sapiens
cagcagcagcagcagcagacaga

SEQ ID NO: 49612 - DNA, 23 bp, Homo sapiens
agcaacagcagcagcaacagcag

SEQ ID NO: 49613 - DNA, 23 bp, Homo sapiens
aacggaagaagcagcttgagcag

SEQ ID NO: 49614 - DNA, 23 bp, Homo sapiens
acaatatgagaacccggttctag

SEQ ID NO: 49615 - DNA, 24 bp, Homo sapiens
ttcttttctaggaatggaaagaac

SEQ ID NO: 49616 - DNA, 24 bp, Homo sapiens
cttcttttctaggaatggaaagaa

SEQ ID NO: 49617 - DNA, 24 bp, Homo sapiens
gcttcttttctaggaatggaaaga

SEQ ID NO: 49618 - DNA, 24 bp, Homo sapiens
cttcagcagtcttgggattggcgt

SEQ ID NO: 49619 - DNA, 24 bp, Homo sapiens
cctatggatggctggctaacttca

SEQ ID NO: 49620 - DNA, 24 bp, Homo sapiens
actgtgtaagcccaagaacaaagg

SEQ ID NO: 49621 - DNA, 24 bp, Homo sapiens
cctggcagagaagacaataaccgt

SEQ ID NO: 49622 - DNA, 24 bp, Homo sapiens
ccccaacgcagaaaacagcaaggc

SEQ ID NO: 49623 - DNA, 24 bp, Homo sapiens
gctcgtggctgggctgtctgtcgc

SEQ ID NO: 49624 - DNA, 24 bp, Homo sapiens
gaagggcagcagcaacaccacgga

SEQ ID NO: 49625 - DNA, 24 bp, Homo sapiens
tctgcgctctctacaaagaggccg

SEQ ID NO: 49626 - DNA, 24 bp, Homo sapiens
gtgcccacctccgagcacgtggcc

SEQ ID NO: 49627 - DNA, 24 bp, Homo sapiens
cattcttgcaggtaataaaccatg

SEQ ID NO: 49628 - DNA, 24 bp, Homo sapiens
acattcttgcaggtaataaaccat

SEQ ID NO: 49629 - DNA, 24 bp, Homo sapiens
aacattcttgcaggtaataaacca

SEQ ID NO: 49630 - DNA, 23 bp, Homo sapiens
cttctctgaggaggaactgagga

SEQ ID NO: 49631 - DNA, 23 bp, Homo sapiens
ctgggcagcagtgttggcagtcg

SEQ ID NO: 49632 - DNA, 24 bp, Homo sapiens
cgagatttgggcacttttgggggt

SEQ ID NO: 49633 - DNA, 24 bp, Homo sapiens
aaactaaaacaggataagggatca

SEQ ID NO: 49634 - DNA, 24 bp, Homo sapiens
aaaactaaaacaggataagggatc

SEQ ID NO: 49635 - DNA, 24 bp, Homo sapiens
aaaaactaaaacaggataagggat

SEQ ID NO: 49636 - DNA, 25 bp, Homo sapiens
ttaataatgcttttccgcaaccgct

SEQ ID NO: 49637 - DNA, 23 bp, Homo sapiens
tgctgctggccctggctgcgctg

SEQ ID NO: 49638 - DNA, 23 bp, Homo sapiens
ttgtgagcctcagcctgcagttc

SEQ ID NO: 49639 - DNA, 24 bp, Homo sapiens
ctgcagctggtgaaaatctgtttt

SEQ ID NO: 49640 - DNA, 25 bp, Homo sapiens
cattcaagaattggggtctggctca

SEQ ID NO: 49641 - DNA, 25 bp, Homo sapiens
gggactccaagatttccatgaagaa

SEQ ID NO: 49642 - DNA, 24 bp, Homo sapiens
ctgggtgctggatgctgaggtgct

SEQ ID NO: 49643 - DNA, 24 bp, Homo sapiens
gctgggtgctggatgctgaggtgc

SEQ ID NO: 49644 - DNA, 24 bp, Homo sapiens
ggctgggtgctggatgctgaggtg

SEQ ID NO: 49645 - DNA, 24 bp, Homo sapiens
ggacacctctcggagccactaatg

SEQ ID NO: 49646 - DNA, 23 bp, Homo sapiens
ctctcacaggagcagcactcgca

SEQ ID NO: 49647 - DNA, 23 bp, Homo sapiens
gcagtcggtggagcaggaggtcc

SEQ ID NO: 49648 - DNA, 24 bp, Homo sapiens
ggcgatagctggtcttattctttt

SEQ ID NO: 49649 - DNA, 24 bp, Homo sapiens
gggcgatagctggtcttattcttt

SEQ ID NO: 49650 - DNA, 24 bp, Homo sapiens
tgggcgatagctggtcttattctt

SEQ ID NO: 49651 - DNA, 24 bp, Homo sapiens
ctcaagtaaagagatatgatcata

SEQ ID NO: 49652 - DNA, 24 bp, Homo sapiens
gctcaagtaaagagatatgatcat

SEQ ID NO: 49653 - DNA, 24 bp, Homo sapiens
tgctcaagtaaagagatatgatca

SEQ ID NO: 49654 - DNA, 24 bp, Homo sapiens
aaactaagcagagatatgatcata

SEQ ID NO: 49655 - DNA, 24 bp, Homo sapiens
gaaactaagcagagatatgatcat

SEQ ID NO: 49656 - DNA, 24 bp, Homo sapiens
tgaaactaagcagagatatgatca

SEQ ID NO: 49657 - DNA, 23 bp, Homo sapiens
ggaagagccagaggaggagcagc

SEQ ID NO: 49658 - DNA, 24 bp, Homo sapiens
ccagaagaaggacagtatgaaggc

SEQ ID NO: 49659 - DNA, 25 bp, Homo sapiens
aagaacaaggagaggatgaactggt

SEQ ID NO: 49660 - DNA, 24 bp, Homo sapiens
ttatcttgtagtttcttctgtatg

SEQ ID NO: 49661 - DNA, 24 bp, Homo sapiens
attatcttgtagtttcttctgtat

SEQ ID NO: 49662 - DNA, 24 bp, Homo sapiens
cattatcttgtagtttcttctgta

SEQ ID NO: 49663 - DNA, 24 bp, Homo sapiens
gggatgcatctggcttctcaaatt

SEQ ID NO: 49664 - DNA, 24 bp, Homo sapiens
agggatgcatctggcttctcaaat

SEQ ID NO: 49665 - DNA, 24 bp, Homo sapiens
aagggatgcatctggcttctcaaa

SEQ ID NO: 49666 - DNA, 24 bp, Homo sapiens
tccgggagaaggtgggtgacatca

SEQ ID NO: 49667 - DNA, 24 bp, Homo sapiens
gtccgggagaaggtgggtgacatc

SEQ ID NO: 49668 - DNA, 24 bp, Homo sapiens
cgtccgggagaaggtgggtgacat

SEQ ID NO: 49669 - DNA, 23 bp, Homo sapiens
gacggcggcgacggaggagagca

SEQ ID NO: 49670 - DNA, 24 bp, Homo sapiens
ggagaagatggaggaggagggtgg

SEQ ID NO: 49671 - DNA, 23 bp, Homo sapiens
cgtccgctgtctcctgggttccc

SEQ ID NO: 49672 - DNA, 24 bp, Homo sapiens
ttcatgatcagaatttattgttca

SEQ ID NO: 49673 - DNA, 24 bp, Homo sapiens
tttcatgatcagaatttattgttc

SEQ ID NO: 49674 - DNA, 24 bp, Homo sapiens
ttttcatgatcagaatttattgtt

SEQ ID NO: 49675 - DNA, 24 bp, Homo sapiens
ccaccaccgcagcagcagcagtcg

SEQ ID NO: 49676 - DNA, 24 bp, Homo sapiens
gcccagccagggccgcgggaggcg

SEQ ID NO: 49677 - DNA, 24 bp, Homo sapiens
cctggccggcgtcagaccgagctg

SEQ ID NO: 49678 - DNA, 24 bp, Homo sapiens
caccagtggcaggcagacgaggac

SEQ ID NO: 49679 - DNA, 24 bp, Homo sapiens
ggcaccatgaacaagttacggcag

SEQ ID NO: 49680 - DNA, 24 bp, Homo sapiens
ccaccaccgcagcagcagcagtcg

SEQ ID NO: 49681 - DNA, 25 bp, Homo sapiens
aagaaggtgttcaaggaagctgtgc

SEQ ID NO: 49682 - DNA, 23 bp, Homo sapiens
ccaagggcaccacaggctacaag

SEQ ID NO: 49683 - DNA, 24 bp, Homo sapiens
gcagaactccaacatcactcgggc

SEQ ID NO: 49684 - DNA, 24 bp, Homo sapiens
tcaggccgagcctgggtctctggc

SEQ ID NO: 49685 - DNA, 24 bp, Homo sapiens
ctcaggccgagcctgggtctctgg

SEQ ID NO: 49686 - DNA, 24 bp, Homo sapiens
cctcaggccgagcctgggtctctg

SEQ ID NO: 49687 - DNA, 24 bp, Homo sapiens
atggtggctgaggtggctgtggac

SEQ ID NO: 49688 - DNA, 24 bp, Homo sapiens
gctcagggaatggtccgtttgtgt

SEQ ID NO: 49689 - DNA, 24 bp, Homo sapiens
caatatggacgtggaggcagagct

SEQ ID NO: 49690 - DNA, 24 bp, Homo sapiens
taaaaaatgagttcggcaaaggtg

SEQ ID NO: 49691 - DNA, 24 bp, Homo sapiens
gtaaaaaatgagttcggcaaaggt

SEQ ID NO: 49692 - DNA, 24 bp, Homo sapiens
tgtaaaaaatgagttcggcaaagg

SEQ ID NO: 49693 - DNA, 23 bp, Homo sapiens
cgcctcagcctgggcctcagcag

SEQ ID NO: 49694 - DNA, 25 bp, Homo sapiens
acatcgaagctcagaacaagatccg

SEQ ID NO: 49695 - DNA, 23 bp, Homo sapiens
gccgtgggtgactgggtgctgag

SEQ ID NO: 49696 - DNA, 23 bp, Homo sapiens
cctgggacggcaactctgatgac

SEQ ID NO: 49697 - DNA, 23 bp, Homo sapiens
tctgccttcctcaagaccattgc

SEQ ID NO: 49698 - DNA, 23 bp, Homo sapiens
ctagagcaggaggagcagcagcg

SEQ ID NO: 49699 - DNA, 25 bp, Homo sapiens
agtggcataaattaggtgtggtggc

SEQ ID NO: 49700 - DNA, 25 bp, Homo sapiens
tggaagcctagtgattcaaagtggg

SEQ ID NO: 49701 - DNA, 23 bp, Homo sapiens
gcgggaggatcacttgagcccag

SEQ ID NO: 49702 - DNA, 23 bp, Homo sapiens
ctctggcttgctgggctgcttgg

SEQ ID NO: 49703 - DNA, 23 bp, Homo sapiens
agggtcccagctatgccaaaaaa

SEQ ID NO: 49704 - DNA, 23 bp, Homo sapiens
gcaagggccacagcagcagccgg

SEQ ID NO: 49705 - DNA, 23 bp, Homo sapiens
ctctggcttgctgggctgcttgg

SEQ ID NO: 49706 - DNA, 24 bp, Homo sapiens
tcagagggtcccagctatgccaaa

SEQ ID NO: 49707 - DNA, 24 bp, Homo sapiens
gcgtttccattggctgtagctccg

SEQ ID NO: 49708 - DNA, 24 bp, Homo sapiens
aatacacaacagataaggagccca

SEQ ID NO: 49709 - DNA, 24 bp, Homo sapiens
gaatacacaacagataaggagccc

SEQ ID NO: 49710 - DNA, 24 bp, Homo sapiens
tgaatacacaacagataaggagcc

SEQ ID NO: 49711 - DNA, 24 bp, Homo sapiens
aatacacaacaaactgttttgagc

SEQ ID NO: 49712 - DNA, 24 bp, Homo sapiens
gaatacacaacaaactgttttgag

SEQ ID NO: 49713 - DNA, 24 bp, Homo sapiens
tgaatacacaacaaactgttttga

SEQ ID NO: 49714 - DNA, 24 bp, Homo sapiens
acccaaagcagtgtgttatcattg

SEQ ID NO: 49715 - DNA, 24 bp, Homo sapiens
gacccaaagcagtgtgttatcatt

SEQ ID NO: 49716 - DNA, 24 bp, Homo sapiens
tgacccaaagcagtgtgttatcat

SEQ ID NO: 49717 - DNA, 24 bp, Homo sapiens
attttcaggaggcttttgaaaatc

SEQ ID NO: 49718 - DNA, 24 bp, Homo sapiens
tattttcaggaggcttttgaaaat

SEQ ID NO: 49719 - DNA, 24 bp, Homo sapiens
ttattttcaggaggcttttgaaaa

SEQ ID NO: 49720 - DNA, 24 bp, Homo sapiens
actacaggaagcaatacaaccaag

SEQ ID NO: 49721 - DNA, 24 bp, Homo sapiens
tactacaggaagcaatacaaccaa

SEQ ID NO: 49722 - DNA, 24 bp, Homo sapiens
atactacaggaagcaatacaacca

SEQ ID NO: 49723 - DNA, 24 bp, Homo sapiens
gagcccgagccagagccagaggaa

SEQ ID NO: 49724 - DNA, 24 bp, Homo sapiens
cagcaggaggaacagccaagtcac

SEQ ID NO: 49725 - DNA, 24 bp, Homo sapiens
gagagaggaggtcgtcgtagagat

SEQ ID NO: 49726 - DNA, 24 bp, Homo sapiens
ctacccctatgaggccccaccgtc

SEQ ID NO: 49727 - DNA, 24 bp, Homo sapiens
gctacccctatgaggccccaccgt

SEQ ID NO: 49728 - DNA, 24 bp, Homo sapiens
ggctacccctatgaggccccaccg

SEQ ID NO: 49729 - DNA, 23 bp, Homo sapiens
ccttgagttctgtgcctggtgcg

SEQ ID NO: 49730 - DNA, 23 bp, Homo sapiens
ctccaccaagagccattcgcagc

SEQ ID NO: 49731 - DNA, 23 bp, Homo sapiens
ggaggaggctgaggctgaggctg

SEQ ID NO: 49732 - DNA, 23 bp, Homo sapiens
tacggaccattgcggaggtggag

SEQ ID NO: 49733 - DNA, 23 bp, Homo sapiens
cagtggcacgagcagatcctggt

SEQ ID NO: 49734 - DNA, 23 bp, Homo sapiens
ggaggaggctgaggctgaggctg

SEQ ID NO: 49735 - DNA, 25 bp, Homo sapiens
gacaacaactctattcaccctctgg

SEQ ID NO: 49736 - DNA, 25 bp, Homo sapiens
ggtggaatggaagttaaggagcctc

SEQ ID NO: 49737 - DNA, 23 bp, Homo sapiens
acctgctggcgtgcgggacctac

SEQ ID NO: 49738 - DNA, 24 bp, Homo sapiens
tgagtgccagtcagccatcaagat

SEQ ID NO: 49739 - DNA, 24 bp, Homo sapiens
tcttctacctcctccgaaccgtgc

SEQ ID NO: 49740 - DNA, 23 bp, Homo sapiens
ctgctcactgcgatgatgctgct

SEQ ID NO: 49741 - DNA, 23 bp, Homo sapiens
ctgctcactgcgatgatgctgct

SEQ ID NO: 49742 - DNA, 24 bp, Homo sapiens
tcttctacctcctccgaaccgtgc

SEQ ID NO: 49743 - DNA, 23 bp, Homo sapiens
ctgtcggtgctgctggcggtgaa

SEQ ID NO: 49744 - DNA, 24 bp, Homo sapiens
tcactttattggttttgtgaatga

SEQ ID NO: 49745 - DNA, 24 bp, Homo sapiens
atcactttattggttttgtgaatg

SEQ ID NO: 49746 - DNA, 24 bp, Homo sapiens
aatcactttattggttttgtgaat

SEQ ID NO: 49747 - DNA, 23 bp, Homo sapiens
cctgctgctgctgctgctcggag

SEQ ID NO: 49748 - DNA, 23 bp, Homo sapiens
ctctcgcagctctcgtcgccact

SEQ ID NO: 49749 - DNA, 23 bp, Homo sapiens
gagcctggctacagctgcacctg

SEQ ID NO: 49750 - DNA, 23 bp, Homo sapiens
cgaacctgagtctgagttgcggc

SEQ ID NO: 49751 - DNA, 23 bp, Homo sapiens
ctgagaggagcaggatggaactg

SEQ ID NO: 49752 - DNA, 23 bp, Homo sapiens
cagtcgtggtcctgctcctggga

SEQ ID NO: 49753 - DNA, 24 bp, Homo sapiens
ggagttccacatgacgactgaggc

SEQ ID NO: 49754 - DNA, 23 bp, Homo sapiens
caccatccgcatggacaccagtg

SEQ ID NO: 49755 - DNA, 23 bp, Homo sapiens
gccccacccgcctggtcctcagt

SEQ ID NO: 49756 - DNA, 23 bp, Homo sapiens
caaggacgacatcaagaaggtga

SEQ ID NO: 49757 - DNA, 23 bp, Homo sapiens
ccgctcccgccgccgccatgtcg

SEQ ID NO: 49758 - DNA, 23 bp, Homo sapiens
ccggtgtcttgggagcagtgccc

SEQ ID NO: 49759 - DNA, 24 bp, Homo sapiens
agcccaaacatattttctggtctg

SEQ ID NO: 49760 - DNA, 24 bp, Homo sapiens
cagcccaaacatattttctggtct

SEQ ID NO: 49761 - DNA, 24 bp, Homo sapiens
tcagcccaaacatattttctggtc

SEQ ID NO: 49762 - DNA, 24 bp, Homo sapiens
tattatccttggtgacattagaca

SEQ ID NO: 49763 - DNA, 24 bp, Homo sapiens
ttattatccttggtgacattagac

SEQ ID NO: 49764 - DNA, 24 bp, Homo sapiens
cttattatccttggtgacattaga

SEQ ID NO: 49765 - DNA, 24 bp, Homo sapiens
tctctttctagttgtccaatctgg

SEQ ID NO: 49766 - DNA, 24 bp, Homo sapiens
ttctctttctagttgtccaatctg

SEQ ID NO: 49767 - DNA, 24 bp, Homo sapiens
tttctctttctagttgtccaatct

SEQ ID NO: 49768 - DNA, 24 bp, Homo sapiens
tagacaggaaggaattaaaattgt

SEQ ID NO: 49769 - DNA, 24 bp, Homo sapiens
gtagacaggaaggaattaaaattg

SEQ ID NO: 49770 - DNA, 24 bp, Homo sapiens
cgtagacaggaaggaattaaaatt

SEQ ID NO: 49771 - DNA, 24 bp, Homo sapiens
ttttgagacagggtctcgctctgt

SEQ ID NO: 49772 - DNA, 24 bp, Homo sapiens
tttttgagacagggtctcgctctg

SEQ ID NO: 49773 - DNA, 24 bp, Homo sapiens
ttttttgagacagggtctcgctct

SEQ ID NO: 49774 - DNA, 24 bp, Homo sapiens
tcacaaaacagaatcaatataatc

SEQ ID NO: 49775 - DNA, 24 bp, Homo sapiens
ctcacaaaacagaatcaatataat

SEQ ID NO: 49776 - DNA, 24 bp, Homo sapiens
tctcacaaaacagaatcaatataa

SEQ ID NO: 49777 - DNA, 24 bp, Homo sapiens
tgctacgataggcaggagtgtgtg

SEQ ID NO: 49778 - DNA, 24 bp, Homo sapiens
ctgctacgataggcaggagtgtgt

SEQ ID NO: 49779 - DNA, 24 bp, Homo sapiens
actgctacgataggcaggagtgtg

SEQ ID NO: 49780 - DNA, 24 bp, Homo sapiens
ctgctgaggactggtggctggaag

SEQ ID NO: 49781 - DNA, 24 bp, Homo sapiens
attattgtcaccgtggcaacctga

SEQ ID NO: 49782 - DNA, 24 bp, Homo sapiens
gcctaagtcattgctgagcctaga

SEQ ID NO: 49783 - DNA, 24 bp, Homo sapiens
ctgctgaggactggtggctggaag

SEQ ID NO: 49784 - DNA, 24 bp, Homo sapiens
cccgtcttatggaaacccgagcag

SEQ ID NO: 49785 - DNA, 24 bp, Homo sapiens
ggctatgaggaacctgacagtgag

SEQ ID NO: 49786 - DNA, 24 bp, Homo sapiens
cccgtcttatggaaacccgagcag

SEQ ID NO: 49787 - DNA, 24 bp, Homo sapiens
agattcttcaaagtgacgcctccc

SEQ ID NO: 49788 - DNA, 24 bp, Homo sapiens
ctgctgaggactggtggctggaag

SEQ ID NO: 49789 - DNA, 24 bp, Homo sapiens
aacctccctggatgcagactctta

SEQ ID NO: 49790 - DNA, 24 bp, Homo sapiens
caacctccctggatgcagactctt

SEQ ID NO: 49791 - DNA, 24 bp, Homo sapiens
gcaacctccctggatgcagactct

SEQ ID NO: 49792 - DNA, 24 bp, Homo sapiens
ggaaaaaactggtaagttataaat

SEQ ID NO: 49793 - DNA, 24 bp, Homo sapiens
tggaaaaaactggtaagttataaa

SEQ ID NO: 49794 - DNA, 24 bp, Homo sapiens
atggaaaaaactggtaagttataa

SEQ ID NO: 49795 - DNA, 24 bp, Homo sapiens
ttggaaattagataatcacacatg

SEQ ID NO: 49796 - DNA, 24 bp, Homo sapiens
tttggaaattagataatcacacat

SEQ ID NO: 49797 - DNA, 24 bp, Homo sapiens
ttttggaaattagataatcacaca

SEQ ID NO: 49798 - DNA, 24 bp, Homo sapiens
ggacaccaaaaaaaactgagggta

SEQ ID NO: 49799 - DNA, 24 bp, Homo sapiens
aggacaccaaaaaaaactgagggt

SEQ ID NO: 49800 - DNA, 24 bp, Homo sapiens
caggacaccaaaaaaaactgaggg

SEQ ID NO: 49801 - DNA, 24 bp, Homo sapiens
tgctatactaggcaaaaagtttta

SEQ ID NO: 49802 - DNA, 24 bp, Homo sapiens
atgctatactaggcaaaaagtttt

SEQ ID NO: 49803 - DNA, 24 bp, Homo sapiens
catgctatactaggcaaaaagttt

SEQ ID NO: 49804 - DNA, 25 bp, Homo sapiens
ccaacaataagaagcatcacacctt

SEQ ID NO: 49805 - DNA, 25 bp, Homo sapiens
tccaaggcagaatcttcactgatgt

SEQ ID NO: 49806 - DNA, 25 bp, Homo sapiens
tggtcatcacaatgtcagcttcatc

SEQ ID NO: 49807 - DNA, 24 bp, Homo sapiens
atctaataatgtgaaaatatggag

SEQ ID NO: 49808 - DNA, 24 bp, Homo sapiens
catctaataatgtgaaaatatgga

SEQ ID NO: 49809 - DNA, 24 bp, Homo sapiens
ccatctaataatgtgaaaatatgg

SEQ ID NO: 49810 - DNA, 24 bp, Homo sapiens
ctggactcgcttggctcatactgc

SEQ ID NO: 49811 - DNA, 24 bp, Homo sapiens
gcaagcacaggacacagacacagt

SEQ ID NO: 49812 - DNA, 25 bp, Homo sapiens
cacacttaggaattacggtcacact

SEQ ID NO: 49813 - DNA, 25 bp, Homo sapiens
ctctgggtggattaaggtgactgcc

SEQ ID NO: 49814 - DNA, 23 bp, Homo sapiens
gccttcgtgtcctcactcttagt

SEQ ID NO: 49815 - DNA, 23 bp, Homo sapiens
gcagcacagccaggacagccatt

SEQ ID NO: 49816 - DNA, 25 bp, Homo sapiens
gggtagaatccagaactttcagcct

SEQ ID NO: 49817 - DNA, 23 bp, Homo sapiens
gtctctagcagtggcagcagcag

SEQ ID NO: 49818 - DNA, 25 bp, Homo sapiens
gctgtctggttggaagaatgtggct

SEQ ID NO: 49819 - DNA, 25 bp, Homo sapiens
aggcaacagattctgacggtaactg

SEQ ID NO: 49820 - DNA, 23 bp, Homo sapiens
gcagcacagccaggacagccatt

SEQ ID NO: 49821 - DNA, 23 bp, Homo sapiens
gccttcgtgtcctcactcttagt

SEQ ID NO: 49822 - DNA, 24 bp, Homo sapiens
aaactccaactccaaaggtcaaac

SEQ ID NO: 49823 - DNA, 24 bp, Homo sapiens
cctgatctctcattgcccacttgg

SEQ ID NO: 49824 - DNA, 24 bp, Homo sapiens
aataaactttcactcctgctctaa

SEQ ID NO: 49825 - DNA, 24 bp, Homo sapiens
tgtcctgctgctggctctggttat

SEQ ID NO: 49826 - DNA, 24 bp, Homo sapiens
gactcctcacaagacagaactggt

SEQ ID NO: 49827 - DNA, 24 bp, Homo sapiens
tgtgcctgtctgttacactggagg

SEQ ID NO: 49828 - DNA, 24 bp, Homo sapiens
tgcccgaggaccttagactgatgg

SEQ ID NO: 49829 - DNA, 23 bp, Homo sapiens
atctcctgacctcgtgatccacc

SEQ ID NO: 49830 - DNA, 24 bp, Homo sapiens
ccttctccaggcagttccttctag

SEQ ID NO: 49831 - DNA, 25 bp, Homo sapiens
gagcggcggaggaaatggacataaa

SEQ ID NO: 49832 - DNA, 24 bp, Homo sapiens
tgtgaaaagccagggaatgaagcc

SEQ ID NO: 49833 - DNA, 23 bp, Homo sapiens
gatccagcaccggctcctcctcc

SEQ ID NO: 49834 - DNA, 24 bp, Homo sapiens
caattattgagaactacaattaca

SEQ ID NO: 49835 - DNA, 24 bp, Homo sapiens
gcaattattgagaactacaattac

SEQ ID NO: 49836 - DNA, 24 bp, Homo sapiens
agcaattattgagaactacaatta

SEQ ID NO: 49837 - DNA, 23 bp, Homo sapiens
cctcctctacttcagccgactct

SEQ ID NO: 49838 - DNA, 23 bp, Homo sapiens
caacagtggtggcagcagaggtg

SEQ ID NO: 49839 - DNA, 23 bp, Homo sapiens
cagcagtggcggcagcagtggtg

SEQ ID NO: 49840 - DNA, 24 bp, Homo sapiens
acctggtttcagtgggacatcagt

SEQ ID NO: 49841 - DNA, 24 bp, Homo sapiens
accgagatgtgatgctggagaact

SEQ ID NO: 49842 - DNA, 24 bp, Homo sapiens
tgaccaagttccaggaggcagtga

SEQ ID NO: 49843 - DNA, 24 bp, Homo sapiens
ccttccccggagtgccgctcctgc

SEQ ID NO: 49844 - DNA, 24 bp, Homo sapiens
gccttccccggagtgccgctcctg

SEQ ID NO: 49845 - DNA, 24 bp, Homo sapiens
cgccttccccggagtgccgctcct

SEQ ID NO: 49846 - DNA, 23 bp, Homo sapiens
agtctaattcagatcgggaagcc

SEQ ID NO: 49847 - DNA, 23 bp, Homo sapiens
aggaagaggaggcggcagctcag

SEQ ID NO: 49848 - DNA, 23 bp, Homo sapiens
tttgccctggccctgccgctgag

SEQ ID NO: 49849 - DNA, 25 bp, Homo sapiens
gcttcacttcactcgcttctccagg

SEQ ID NO: 49850 - DNA, 23 bp, Homo sapiens
cagttctcctgcctcagccttcc

SEQ ID NO: 49851 - DNA, 23 bp, Homo sapiens
cctgtgcgtccagttcggagagg

SEQ ID NO: 49852 - DNA, 23 bp, Homo sapiens
ccgccgctgctgctgctgctgtg

SEQ ID NO: 49853 - DNA, 23 bp, Homo sapiens
cgggctaggggcgcgtcatgtgg

SEQ ID NO: 49854 - DNA, 23 bp, Homo sapiens
ttcggcagctccagttcagctcg

SEQ ID NO: 49855 - DNA, 23 bp, Homo sapiens
acccacgcctcgctgccccgctt

SEQ ID NO: 49856 - DNA, 23 bp, Homo sapiens
ctcaacctgggcatgcgcccccc

SEQ ID NO: 49857 - DNA, 24 bp, Homo sapiens
cagattaaaaggtaaccaggacat

SEQ ID NO: 49858 - DNA, 24 bp, Homo sapiens
tcagattaaaaggtaaccaggaca

SEQ ID NO: 49859 - DNA, 24 bp, Homo sapiens
atcagattaaaaggtaaccaggac

SEQ ID NO: 49860 - DNA, 24 bp, Homo sapiens
ccatatcaaatggcatggtgtctc

SEQ ID NO: 49861 - DNA, 24 bp, Homo sapiens
tccatatcaaatggcatggtgtct

SEQ ID NO: 49862 - DNA, 24 bp, Homo sapiens
ctccatatcaaatggcatggtgtc

SEQ ID NO: 49863 - DNA, 24 bp, Homo sapiens
aagttttaaagatacagcagaatc

SEQ ID NO: 49864 - DNA, 24 bp, Homo sapiens
aaagttttaaagatacagcagaat

SEQ ID NO: 49865 - DNA, 24 bp, Homo sapiens
gaaagttttaaagatacagcagaa

SEQ ID NO: 49866 - DNA, 24 bp, Homo sapiens
gttacaacaagaaaatgacagaga

SEQ ID NO: 49867 - DNA, 24 bp, Homo sapiens
tgttacaacaagaaaatgacagag

SEQ ID NO: 49868 - DNA, 24 bp, Homo sapiens
ctgttacaacaagaaaatgacaga

SEQ ID NO: 49869 - DNA, 24 bp, Homo sapiens
gcacggaggaagtggaagcagaat

SEQ ID NO: 49870 - DNA, 24 bp, Homo sapiens
gcgaaggcaggcgttcaaggatat

SEQ ID NO: 49871 - DNA, 24 bp, Homo sapiens
ttctaggcagaacctggagtcggc

SEQ ID NO: 49872 - DNA, 23 bp, Homo sapiens
agtgcgtggtggtggtcttgctg

SEQ ID NO: 49873 - DNA, 24 bp, Homo sapiens
cgactatggctacaacctggtggc

SEQ ID NO: 49874 - DNA, 23 bp, Homo sapiens
gctctcctgctgctcatgctgac

SEQ ID NO: 49875 - DNA, 24 bp, Homo sapiens
agctggagaatagtaagcgtaaat

SEQ ID NO: 49876 - DNA, 24 bp, Homo sapiens
cagctggagaatagtaagcgtaaa

SEQ ID NO: 49877 - DNA, 24 bp, Homo sapiens
acagctggagaatagtaagcgtaa

SEQ ID NO: 49878 - DNA, 25 bp, Homo sapiens
gccaggttgcgaattagtgtgaagg

SEQ ID NO: 49879 - DNA, 24 bp, Homo sapiens
aacaagtacaagcgtaaggagagg

SEQ ID NO: 49880 - DNA, 24 bp, Homo sapiens
atcaggcaaatgttgggattattc

SEQ ID NO: 49881 - DNA, 24 bp, Homo sapiens
ggtgcgtgatgtggctaagatgct

SEQ ID NO: 49882 - DNA, 24 bp, Homo sapiens
agtaggagagactggtgcttgccc

SEQ ID NO: 49883 - DNA, 24 bp, Homo sapiens
ttcacagaacaattgaggcgaggc

SEQ ID NO: 49884 - DNA, 24 bp, Homo sapiens
tatgtggataccttacttactatg

SEQ ID NO: 49885 - DNA, 24 bp, Homo sapiens
ctgttgttttcacaaggcaaaatg

SEQ ID NO: 49886 - DNA, 24 bp, Homo sapiens
gaactgaagttattgcttcatcgt

SEQ ID NO: 49887 - DNA, 24 bp, Homo sapiens
caggaaaacaagctcagggctccc

SEQ ID NO: 49888 - DNA, 24 bp, Homo sapiens
tgaggaagtcagttcacaaggtct

SEQ ID NO: 49889 - DNA, 24 bp, Homo sapiens
gaggaggaggaggaggaggaggaa

SEQ ID NO: 49890 - DNA, 24 bp, Homo sapiens
ccactgcgggcgatgtatttgtat

SEQ ID NO: 49891 - DNA, 24 bp, Homo sapiens
tttcaatgtgggcttcaaagaggc

SEQ ID NO: 49892 - DNA, 24 bp, Homo sapiens
cggaactattacggatgtggagaa

SEQ ID NO: 49893 - DNA, 24 bp, Homo sapiens
tggtgtaagtgggctgacagtgga

SEQ ID NO: 49894 - DNA, 23 bp, Homo sapiens
atgcagccagccagccaagtaag

SEQ ID NO: 49895 - DNA, 23 bp, Homo sapiens
tcctggagcggacagcgtcaagg

SEQ ID NO: 49896 - DNA, 25 bp, Homo sapiens
catccactctgcggaggaatgactc

SEQ ID NO: 49897 - DNA, 24 bp, Homo sapiens
gaaagtgagaagtaagtgacatgc

SEQ ID NO: 49898 - DNA, 24 bp, Homo sapiens
ggaaagtgagaagtaagtgacatg

SEQ ID NO: 49899 - DNA, 24 bp, Homo sapiens
tggaaagtgagaagtaagtgacat

SEQ ID NO: 49900 - DNA, 24 bp, Homo sapiens
ggagtcagcccgccagcccgccag

SEQ ID NO: 49901 - DNA, 24 bp, Homo sapiens
gagcagatccggggtagagggaaa

SEQ ID NO: 49902 - DNA, 24 bp, Homo sapiens
gggcctgcgcttaccggaaagagg

SEQ ID NO: 49903 - DNA, 24 bp, Homo sapiens
tgacacagaaaaaaatgttgagaa

SEQ ID NO: 49904 - DNA, 24 bp, Homo sapiens
ttgacacagaaaaaaatgttgaga

SEQ ID NO: 49905 - DNA, 24 bp, Homo sapiens
attgacacagaaaaaaatgttgag

SEQ ID NO: 49906 - DNA, 24 bp, Homo sapiens
ccgagttgaggtcctgattaaccg

SEQ ID NO: 49907 - DNA, 23 bp, Homo sapiens
aggaactggactcgctgcatgga

SEQ ID NO: 49908 - DNA, 23 bp, Homo sapiens
gaggcacacaggaagcacaccat

SEQ ID NO: 49909 - DNA, 24 bp, Homo sapiens
tttccttttaggcgaaagttcacc

SEQ ID NO: 49910 - DNA, 24 bp, Homo sapiens
ttttccttttaggcgaaagttcac

SEQ ID NO: 49911 - DNA, 24 bp, Homo sapiens
tttttccttttaggcgaaagttca

SEQ ID NO: 49912 - DNA, 24 bp, Homo sapiens
catctgcttcacgctggtctcctt

SEQ ID NO: 49913 - DNA, 24 bp, Homo sapiens
ttcgtggagtttatcttggagcct

SEQ ID NO: 49914 - DNA, 24 bp, Homo sapiens
ggcatccacctgacgaaggaggag

SEQ ID NO: 49915 - DNA, 24 bp, Homo sapiens
atcagtaaaaggtgagttataaat

SEQ ID NO: 49916 - DNA, 24 bp, Homo sapiens
tatcagtaaaaggtgagttataaa

SEQ ID NO: 49917 - DNA, 24 bp, Homo sapiens
ctatcagtaaaaggtgagttataa

SEQ ID NO: 49918 - DNA, 24 bp, Homo sapiens
attcaaactatctaaagaacagta

SEQ ID NO: 49919 - DNA, 24 bp, Homo sapiens
cattcaaactatctaaagaacagt

SEQ ID NO: 49920 - DNA, 24 bp, Homo sapiens
ccattcaaactatctaaagaacag

SEQ ID NO: 49921 - DNA, 24 bp, Homo sapiens
ttaacacttataattcttagttac

SEQ ID NO: 49922 - DNA, 24 bp, Homo sapiens
tttaacacttataattcttagtta

SEQ ID NO: 49923 - DNA, 24 bp, Homo sapiens
atttaacacttataattcttagtt

SEQ ID NO: 49924 - DNA, 24 bp, Homo sapiens
tctggacaacagtgagttacaaac

SEQ ID NO: 49925 - DNA, 24 bp, Homo sapiens
ctctggacaacagtgagttacaaa

SEQ ID NO: 49926 - DNA, 24 bp, Homo sapiens
actctggacaacagtgagttacaa

SEQ ID NO: 49927 - DNA, 23 bp, Homo sapiens
gggcaggcaggcttcagaactct

SEQ ID NO: 49928 - DNA, 24 bp, Homo sapiens
cgggagcacaagcagaaatagatt

SEQ ID NO: 49929 - DNA, 25 bp, Homo sapiens
gttatttccaaagttgaggctcggg

SEQ ID NO: 49930 - DNA, 23 bp, Homo sapiens
caggcaggcagacagacagaggt

SEQ ID NO: 49931 - DNA, 23 bp, Homo sapiens
ccacagagcagctcggactcagc

SEQ ID NO: 49932 - DNA, 23 bp, Homo sapiens
agaaggaggagcagccaaggagg

SEQ ID NO: 49933 - DNA, 24 bp, Homo sapiens
gagctggtgctgttcctgctggag

SEQ ID NO: 49934 - DNA, 24 bp, Homo sapiens
ggagctggtgctgttcctgctgga

SEQ ID NO: 49935 - DNA, 24 bp, Homo sapiens
aggagctggtgctgttcctgctgg

SEQ ID NO: 49936 - DNA, 23 bp, Homo sapiens
cctcctgtggctgctgcttctag

SEQ ID NO: 49937 - DNA, 24 bp, Homo sapiens
aactcccaacttcctcgcaaaccc

SEQ ID NO: 49938 - DNA, 23 bp, Homo sapiens
gctcatggtctgtggctgctctg

SEQ ID NO: 49939 - DNA, 23 bp, Homo sapiens
gtgaccgtggacaagaggacagc

SEQ ID NO: 49940 - DNA, 23 bp, Homo sapiens
gctgcgaggacagtgatctggac

SEQ ID NO: 49941 - DNA, 23 bp, Homo sapiens
ggaggtggatggtgctgtcctga

SEQ ID NO: 49942 - DNA, 24 bp, Homo sapiens
acaaaatacaggtacaatttaaat

SEQ ID NO: 49943 - DNA, 24 bp, Homo sapiens
aacaaaatacaggtacaatttaaa

SEQ ID NO: 49944 - DNA, 24 bp, Homo sapiens
caacaaaatacaggtacaatttaa

SEQ ID NO: 49945 - DNA, 24 bp, Homo sapiens
gtgtgcaagatgaagccgagcctt

SEQ ID NO: 49946 - DNA, 24 bp, Homo sapiens
agggtgtgggtgccgctctcactc

SEQ ID NO: 49947 - DNA, 24 bp, Homo sapiens
gtccctcccacccacagccacgcc

SEQ ID NO: 49948 - DNA, 24 bp, Homo sapiens
ggcagagacgctcctcacttccta

SEQ ID NO: 49949 - DNA, 25 bp, Homo sapiens
ggaggcaagttagagaaggaagacc

SEQ ID NO: 49950 - DNA, 23 bp, Homo sapiens
tcacatgaagcggaggaccacgg

SEQ ID NO: 49951 - DNA, 24 bp, Homo sapiens
cttgaagatgagcttatccatata

SEQ ID NO: 49952 - DNA, 24 bp, Homo sapiens
acttgaagatgagcttatccatat

SEQ ID NO: 49953 - DNA, 24 bp, Homo sapiens
tacttgaagatgagcttatccata

SEQ ID NO: 49954 - DNA, 25 bp, Homo sapiens
ccgactcgccgatgatctcaatgaa

SEQ ID NO: 49955 - DNA, 25 bp, Homo sapiens
acattcttcctgtggattctgctgt

SEQ ID NO: 49956 - DNA, 24 bp, Homo sapiens
ttgaagaggacagcagcagcgatg

SEQ ID NO: 49957 - DNA, 24 bp, Homo sapiens
ccagaccagaaggcagagaagtcc

SEQ ID NO: 49958 - DNA, 24 bp, Homo sapiens
cctatggactcagcctacgctcgg

SEQ ID NO: 49959 - DNA, 23 bp, Homo sapiens
agcagcagcagcaacaccgattc

SEQ ID NO: 49960 - DNA, 25 bp, Homo sapiens
aactcttcttcaacgccactgagca

SEQ ID NO: 49961 - DNA, 23 bp, Homo sapiens
agcagcagcagcaacaccgattc

SEQ ID NO: 49962 - DNA, 24 bp, Homo sapiens
ccagaccagaaggcagagaagtcc

SEQ ID NO: 49963 - DNA, 23 bp, Homo sapiens
ttgacattggctggctggctgag

SEQ ID NO: 49964 - DNA, 25 bp, Homo sapiens
gctgattggatagaacctgcctgcc

SEQ ID NO: 49965 - DNA, 25 bp, Homo sapiens
aaggaatatgacatacagtgctggc

SEQ ID NO: 49966 - DNA, 23 bp, Homo sapiens
ctgggccagctgaccacggaggg

SEQ ID NO: 49967 - DNA, 23 bp, Homo sapiens
ggcctcctaccccatggacccac

SEQ ID NO: 49968 - DNA, 23 bp, Homo sapiens
agcagctggagctgggccgcttc

SEQ ID NO: 49969 - DNA, 25 bp, Homo sapiens
attgaccctaccctgctccattaca

SEQ ID NO: 49970 - DNA, 25 bp, Homo sapiens
gctaccttgcagaactgatggaaca

SEQ ID NO: 49971 - DNA, 23 bp, Homo sapiens
ccgttatggtgtgagaggctgtc

SEQ ID NO: 49972 - DNA, 23 bp, Homo sapiens
aacgccaagcagcccaccgacat

SEQ ID NO: 49973 - DNA, 23 bp, Homo sapiens
ttcgtcgtgaggtgcatcgcgta

SEQ ID NO: 49974 - DNA, 23 bp, Homo sapiens
agcggaggatccgcctgcagctc

SEQ ID NO: 49975 - DNA, 23 bp, Homo sapiens
gtacaatggaagtggaaggagaa

SEQ ID NO: 49976 - DNA, 25 bp, Homo sapiens
ctgtcattcaccttagagattgtca

SEQ ID NO: 49977 - DNA, 25 bp, Homo sapiens
ttggacataggagatgagaatgaga

SEQ ID NO: 49978 - DNA, 24 bp, Homo sapiens
aaaacccccaaaatctgattaaaa

SEQ ID NO: 49979 - DNA, 24 bp, Homo sapiens
taaaacccccaaaatctgattaaa

SEQ ID NO: 49980 - DNA, 24 bp, Homo sapiens
ttaaaacccccaaaatctgattaa

SEQ ID NO: 49981 - DNA, 24 bp, Homo sapiens
gtccaggtccgagaggagctgctg

SEQ ID NO: 49982 - DNA, 24 bp, Homo sapiens
cagcaggtggtgagccgcatccgc

SEQ ID NO: 49983 - DNA, 24 bp, Homo sapiens
cggctggtggaggtgaacggcgaa

SEQ ID NO: 49984 - DNA, 25 bp, Homo sapiens
aggttggaagtcctgttggaagtgc

SEQ ID NO: 49985 - DNA, 25 bp, Homo sapiens
gccttcctcccattctcatctccac

SEQ ID NO: 49986 - DNA, 25 bp, Homo sapiens
aaggagactatgctgtggaagagaa

SEQ ID NO: 49987 - DNA, 24 bp, Homo sapiens
gttggtgcgagtgatggcattatt

SEQ ID NO: 49988 - DNA, 24 bp, Homo sapiens
ggttggtgcgagtgatggcattat

SEQ ID NO: 49989 - DNA, 24 bp, Homo sapiens
tggttggtgcgagtgatggcatta

SEQ ID NO: 49990 - DNA, 24 bp, Homo sapiens
ggctggagcagtgggccggtcagg

SEQ ID NO: 49991 - DNA, 24 bp, Homo sapiens
cggctggagcagtgggccggtcag

SEQ ID NO: 49992 - DNA, 24 bp, Homo sapiens
gcggctggagcagtgggccggtca

SEQ ID NO: 49993 - DNA, 23 bp, Homo sapiens
ttcctgccgctgctgctgcttgc

SEQ ID NO: 49994 - DNA, 23 bp, Homo sapiens
tcctacaagccggtcatcgtggt

SEQ ID NO: 49995 - DNA, 25 bp, Homo sapiens
ccgccacctgctggaatacatcaat

SEQ ID NO: 49996 - DNA, 23 bp, Homo sapiens
caggagattcacgagctgcgagg

SEQ ID NO: 49997 - DNA, 23 bp, Homo sapiens
aaccagtgccagcatactcagcg

SEQ ID NO: 49998 - DNA, 23 bp, Homo sapiens
ttaatacggcaggcagcttcacc

SEQ ID NO: 49999 - DNA, 24 bp, Homo sapiens
ttttaatacagtttacgtttaata

SEQ ID NO: 50000 - DNA, 24 bp, Homo sapiens
cttttaatacagtttacgtttaat

SEQ ID NO: 50001 - DNA, 24 bp, Homo sapiens
ccttttaatacagtttacgtttaa

SEQ ID NO: 50002 - DNA, 24 bp, Homo sapiens
atccctctacagcctcacggacca

SEQ ID NO: 50003 - DNA, 24 bp, Homo sapiens
cctccagagactgatcctagccag

SEQ ID NO: 50004 - DNA, 24 bp, Homo sapiens
tccatcaccaccaccagagcctcc

SEQ ID NO: 50005 - DNA, 25 bp, Homo sapiens
agttcttctgctacgacctgtcaca

SEQ ID NO: 50006 - DNA, 24 bp, Homo sapiens
atccagagcagcactgatgagatc

SEQ ID NO: 50007 - DNA, 23 bp, Homo sapiens
ggctgtctggctggtcatcaacc

SEQ ID NO: 50008 - DNA, 23 bp, Homo sapiens
gcagaaggtggtagaggagagcc

SEQ ID NO: 50009 - DNA, 24 bp, Homo sapiens
tgactgacacgctgattgatgaca

SEQ ID NO: 50010 - DNA, 24 bp, Homo sapiens
atcatcaagaccagcctgtgcgtg

SEQ ID NO: 50011 - DNA, 23 bp, Homo sapiens
tactgcccaccccgcttcccacc

SEQ ID NO: 50012 - DNA, 23 bp, Homo sapiens
cgagtactaccagatctaccgtg

SEQ ID NO: 50013 - DNA, 25 bp, Homo sapiens
caaacccctggtgaagatggcagac

SEQ ID NO: 50014 - DNA, 23 bp, Homo sapiens
gtcggctcgctacttcttgtggc

SEQ ID NO: 50015 - DNA, 23 bp, Homo sapiens
aactgttgctgctcctgctgctg

SEQ ID NO: 50016 - DNA, 24 bp, Homo sapiens
cctgttcctctactctgtgcctgg

SEQ ID NO: 50017 - DNA, 24 bp, Homo sapiens
ctaagccgccgatacattatcacc

SEQ ID NO: 50018 - DNA, 24 bp, Homo sapiens
aatctcggctcactggtccctttg

SEQ ID NO: 50019 - DNA, 24 bp, Homo sapiens
cgcctcgctaagtgctttgctacg

SEQ ID NO: 50020 - DNA, 24 bp, Homo sapiens
atatagatcaagtaagagacagaa

SEQ ID NO: 50021 - DNA, 24 bp, Homo sapiens
aatatagatcaagtaagagacaga

SEQ ID NO: 50022 - DNA, 24 bp, Homo sapiens
aaatatagatcaagtaagagacag

SEQ ID NO: 50023 - DNA, 24 bp, Homo sapiens
agggactaaataaaccagaaagta

SEQ ID NO: 50024 - DNA, 24 bp, Homo sapiens
gagggactaaataaaccagaaagt

SEQ ID NO: 50025 - DNA, 24 bp, Homo sapiens
ggagggactaaataaaccagaaag

SEQ ID NO: 50026 - DNA, 24 bp, Homo sapiens
ttattttctaggaagtaaggtacg

SEQ ID NO: 50027 - DNA, 24 bp, Homo sapiens
tttattttctaggaagtaaggtac

SEQ ID NO: 50028 - DNA, 24 bp, Homo sapiens
ttttattttctaggaagtaaggta

SEQ ID NO: 50029 - DNA, 23 bp, Homo sapiens
ggaccagcagcaacagcatcacc

SEQ ID NO: 50030 - DNA, 25 bp, Homo sapiens
gatagcctcataactctaccaccat

SEQ ID NO: 50031 - DNA, 25 bp, Homo sapiens
aactgatgacctagaagagcgattc

SEQ ID NO: 50032 - DNA, 23 bp, Homo sapiens
caactccagcagcagcagcatct

SEQ ID NO: 50033 - DNA, 24 bp, Homo sapiens
ggactcatctccattccacctggc

SEQ ID NO: 50034 - DNA, 24 bp, Homo sapiens
cacttcctgtccaatcgctgcctc

SEQ ID NO: 50035 - DNA, 25 bp, Homo sapiens
cgactacctcctccaacacttccaa

SEQ ID NO: 50036 - DNA, 24 bp, Homo sapiens
cacttcctgtccaatcgctgcctc

SEQ ID NO: 50037 - DNA, 23 bp, Homo sapiens
caactccagcagcagcagcatct

SEQ ID NO: 50038 - DNA, 24 bp, Homo sapiens
tcttgctgctgttggtcaccttcc

SEQ ID NO: 50039 - DNA, 24 bp, Homo sapiens
acctacgagcggatgattgtgttc

SEQ ID NO: 50040 - DNA, 24 bp, Homo sapiens
atctgaggacacgagccttcaacg

SEQ ID NO: 50041 - DNA, 24 bp, Homo sapiens
ggaagcatgaactcaatggcagga

SEQ ID NO: 50042 - DNA, 24 bp, Homo sapiens
ctggaggtagaccgcgtggagctg

SEQ ID NO: 50043 - DNA, 24 bp, Homo sapiens
cgtgctccagccgccccaggacag

SEQ ID NO: 50044 - DNA, 23 bp, Homo sapiens
acttatcttgctggacacgccgc

SEQ ID NO: 50045 - DNA, 23 bp, Homo sapiens
caagcggagagccatagagcacg

SEQ ID NO: 50046 - DNA, 25 bp, Homo sapiens
gcagaggcagagaacagcattgact

SEQ ID NO: 50047 - DNA, 24 bp, Homo sapiens
ggcactcccaatacagcttaccgt

SEQ ID NO: 50048 - DNA, 24 bp, Homo sapiens
ttcctggctgtgaagaggctggta

SEQ ID NO: 50049 - DNA, 24 bp, Homo sapiens
ttagccaccaagcagccccaggac

SEQ ID NO: 50050 - DNA, 24 bp, Homo sapiens
ttccaagaagtcagcatccgtgtg

SEQ ID NO: 50051 - DNA, 24 bp, Homo sapiens
cgagaagcggagatggaacgagga

SEQ ID NO: 50052 - DNA, 24 bp, Homo sapiens
aggtccagcaggagagcagccaag

SEQ ID NO: 50053 - DNA, 24 bp, Homo sapiens
atgttttgaagattttaagtaacc

SEQ ID NO: 50054 - DNA, 24 bp, Homo sapiens
gatgttttgaagattttaagtaac

SEQ ID NO: 50055 - DNA, 24 bp, Homo sapiens
agatgttttgaagattttaagtaa

SEQ ID NO: 50056 - DNA, 24 bp, Homo sapiens
cagccccacaaccaccggccctct

SEQ ID NO: 50057 - DNA, 24 bp, Homo sapiens
ccagccccacaaccaccggccctc

SEQ ID NO: 50058 - DNA, 24 bp, Homo sapiens
cccagccccacaaccaccggccct

SEQ ID NO: 50059 - DNA, 24 bp, Homo sapiens
cctgctcaatccacaatatcacca

SEQ ID NO: 50060 - DNA, 24 bp, Homo sapiens
tctccaatggctaccacctccact

SEQ ID NO: 50061 - DNA, 24 bp, Homo sapiens
ttcatccctcctcaaacacacctg

SEQ ID NO: 50062 - DNA, 24 bp, Homo sapiens
cacagtggaccttgggacctcagg

SEQ ID NO: 50063 - DNA, 24 bp, Homo sapiens
ctgcgcccaacaccagcactcctg

SEQ ID NO: 50064 - DNA, 24 bp, Homo sapiens
gccacacctctgatgagtaccacc

SEQ ID NO: 50065 - DNA, 24 bp, Homo sapiens
gcatcattccacaaacaccgcagt

SEQ ID NO: 50066 - DNA, 24 bp, Homo sapiens
tcacaatcctctgtcctagctgac

SEQ ID NO: 50067 - DNA, 24 bp, Homo sapiens
gccaccacattcctgcctcctctg

SEQ ID NO: 50068 - DNA, 24 bp, Homo sapiens
ggtccagatgagcctcctacaact

SEQ ID NO: 50069 - DNA, 24 bp, Homo sapiens
aggtctgtgaagaacggtgctgag

SEQ ID NO: 50070 - DNA, 24 bp, Homo sapiens
gcttattaatggtaagttttaata

SEQ ID NO: 50071 - DNA, 24 bp, Homo sapiens
ggcttattaatggtaagttttaat

SEQ ID NO: 50072 - DNA, 24 bp, Homo sapiens
tggcttattaatggtaagttttaa

SEQ ID NO: 50073 - DNA, 23 bp, Homo sapiens
gagggacggcagcagcagcatca

SEQ ID NO: 50074 - DNA, 23 bp, Homo sapiens
gcaggagaccatcgcagagtttt

SEQ ID NO: 50075 - DNA, 23 bp, Homo sapiens
ctgagtgcgacccccacccccct

SEQ ID NO: 50076 - DNA, 24 bp, Homo sapiens
ggacgccaattgtagtcggtcttc

SEQ ID NO: 50077 - DNA, 24 bp, Homo sapiens
gggacgccaattgtagtcggtctt

SEQ ID NO: 50078 - DNA, 24 bp, Homo sapiens
tgggacgccaattgtagtcggtct

SEQ ID NO: 50079 - DNA, 23 bp, Homo sapiens
gcgagaacaaagaggtgccccgg

SEQ ID NO: 50080 - DNA, 23 bp, Homo sapiens
cgggcacgggcgaagaggcgggc

SEQ ID NO: 50081 - DNA, 23 bp, Homo sapiens
gatgaggagcaggagccgccgcc

SEQ ID NO: 50082 - DNA, 25 bp, Homo sapiens
tgctcaagaaggaatataaagaaga

SEQ ID NO: 50083 - DNA, 23 bp, Homo sapiens
ctgctcagcttccaggacgagga

SEQ ID NO: 50084 - DNA, 23 bp, Homo sapiens
gatgaggagcaggagccgccgcc

SEQ ID NO: 50085 - DNA, 24 bp, Homo sapiens
accttcggcaggtaaaaattttta

SEQ ID NO: 50086 - DNA, 24 bp, Homo sapiens
taccttcggcaggtaaaaattttt

SEQ ID NO: 50087 - DNA, 24 bp, Homo sapiens
ataccttcggcaggtaaaaatttt

SEQ ID NO: 50088 - DNA, 24 bp, Homo sapiens
tctttttaaagactgttttaaaga

SEQ ID NO: 50089 - DNA, 24 bp, Homo sapiens
ttctttttaaagactgttttaaag

SEQ ID NO: 50090 - DNA, 24 bp, Homo sapiens
tttctttttaaagactgttttaaa

SEQ ID NO: 50091 - DNA, 24 bp, Homo sapiens
gcttgggcatcaggtcaactctct

SEQ ID NO: 50092 - DNA, 24 bp, Homo sapiens
cggattacatcaaggagttggtga

SEQ ID NO: 50093 - DNA, 24 bp, Homo sapiens
tgaaaggatgattgctcacaaaca

SEQ ID NO: 50094 - DNA, 24 bp, Homo sapiens
aagatagaactcaggctggacgca

SEQ ID NO: 50095 - DNA, 24 bp, Homo sapiens
gctgctctggaggctgagatagga

SEQ ID NO: 50096 - DNA, 24 bp, Homo sapiens
gctgagatggtgccacttcactcc

SEQ ID NO: 50097 - DNA, 25 bp, Homo sapiens
atcctgggcgtcctaaagagagatg

SEQ ID NO: 50098 - DNA, 23 bp, Homo sapiens
tgaaaaaagtggaggacaagaga

SEQ ID NO: 50099 - DNA, 25 bp, Homo sapiens
tcatcaatctgtcatttttattaga

SEQ ID NO: 50100 - DNA, 24 bp, Homo sapiens
atgtatttgaggtaatacattttt

SEQ ID NO: 50101 - DNA, 24 bp, Homo sapiens
aatgtatttgaggtaatacatttt

SEQ ID NO: 50102 - DNA, 24 bp, Homo sapiens
gaatgtatttgaggtaatacattt

SEQ ID NO: 50103 - DNA, 24 bp, Homo sapiens
tttgtcttaagcctttaaagtatc

SEQ ID NO: 50104 - DNA, 24 bp, Homo sapiens
ttttgtcttaagcctttaaagtat

SEQ ID NO: 50105 - DNA, 24 bp, Homo sapiens
tttttgtcttaagcctttaaagta

SEQ ID NO: 50106 - DNA, 23 bp, Homo sapiens
ggagcaccggcagcagccaccaa

SEQ ID NO: 50107 - DNA, 23 bp, Homo sapiens
ctgcccccagaggcgctcttcca

SEQ ID NO: 50108 - DNA, 23 bp, Homo sapiens
cccgggggccaggtgggagcccg

SEQ ID NO: 50109 - DNA, 23 bp, Homo sapiens
tgctgaccatcgcccaccgcctc

SEQ ID NO: 50110 - DNA, 23 bp, Homo sapiens
ttctcaactgcgatcacgtcctg

SEQ ID NO: 50111 - DNA, 25 bp, Homo sapiens
ccgcctctatggactccaagactga

SEQ ID NO: 50112 - DNA, 24 bp, Homo sapiens
tgttctaacaggtgaaaagaaact

SEQ ID NO: 50113 - DNA, 24 bp, Homo sapiens
ttgttctaacaggtgaaaagaaac

SEQ ID NO: 50114 - DNA, 24 bp, Homo sapiens
cttgttctaacaggtgaaaagaaa

SEQ ID NO: 50115 - DNA, 24 bp, Homo sapiens
ctacaaaaaaggtaagtttctttt

SEQ ID NO: 50116 - DNA, 24 bp, Homo sapiens
cctacaaaaaaggtaagtttcttt

SEQ ID NO: 50117 - DNA, 24 bp, Homo sapiens
gcctacaaaaaaggtaagtttctt

SEQ ID NO: 50118 - DNA, 25 bp, Homo sapiens
gagttctaccgtcagtcctggcatt

SEQ ID NO: 50119 - DNA, 24 bp, Homo sapiens
ccttgggaatgctgctgtgcttat

SEQ ID NO: 50120 - DNA, 25 bp, Homo sapiens
ctacaaggagccttaggaggtacgg

SEQ ID NO: 50121 - DNA, 24 bp, Homo sapiens
tttatgaacaggttgaaaggattg

SEQ ID NO: 50122 - DNA, 24 bp, Homo sapiens
ttttatgaacaggttgaaaggatt

SEQ ID NO: 50123 - DNA, 24 bp, Homo sapiens
cttttatgaacaggttgaaaggat

SEQ ID NO: 50124 - DNA, 24 bp, Homo sapiens
gtatctccagcctctgcctccaca

SEQ ID NO: 50125 - DNA, 24 bp, Homo sapiens
gatgctggcttcttcactgtcacc

SEQ ID NO: 50126 - DNA, 24 bp, Homo sapiens
cgctaaccgtgagatgccagtacc

SEQ ID NO: 50127 - DNA, 24 bp, Homo sapiens
tatttccacagatccggaacatgg

SEQ ID NO: 50128 - DNA, 24 bp, Homo sapiens
ttatttccacagatccggaacatg

SEQ ID NO: 50129 - DNA, 24 bp, Homo sapiens
tttatttccacagatccggaacat

SEQ ID NO: 50130 - DNA, 24 bp, Homo sapiens
ctgctgctgctgctgctgctgctg

SEQ ID NO: 50131 - DNA, 24 bp, Homo sapiens
gggagaggcaggcgtcagtggctg

SEQ ID NO: 50132 - DNA, 24 bp, Homo sapiens
cctagcacgtccttgccttcttgg

SEQ ID NO: 50133 - DNA, 25 bp, Homo sapiens
ccaatggagaagactcaagaaacag

SEQ ID NO: 50134 - DNA, 24 bp, Homo sapiens
gaattcttctagaaccctataaat

SEQ ID NO: 50135 - DNA, 24 bp, Homo sapiens
cctcccaccaggtgcccccgagcc

SEQ ID NO: 50136 - DNA, 24 bp, Homo sapiens
gcctcccaccaggtgcccccgagc

SEQ ID NO: 50137 - DNA, 24 bp, Homo sapiens
cgcctcccaccaggtgcccccgag

SEQ ID NO: 50138 - DNA, 24 bp, Homo sapiens
ggtctggtggctggcttgctgtgt

SEQ ID NO: 50139 - DNA, 24 bp, Homo sapiens
tcagagtaaagaccttcaagaccc

SEQ ID NO: 50140 - DNA, 24 bp, Homo sapiens
gtatctgtcccatctaccttgaac

SEQ ID NO: 50141 - DNA, 24 bp, Homo sapiens
ccggagatgggagaacagcccatc

SEQ ID NO: 50142 - DNA, 24 bp, Homo sapiens
gccggagatgggagaacagcccat

SEQ ID NO: 50143 - DNA, 24 bp, Homo sapiens
cgccggagatgggagaacagccca

SEQ ID NO: 50144 - DNA, 24 bp, Homo sapiens
ttttctaatagggaaaaataccaa

SEQ ID NO: 50145 - DNA, 24 bp, Homo sapiens
tttttctaatagggaaaaatacca

SEQ ID NO: 50146 - DNA, 24 bp, Homo sapiens
ctttttctaatagggaaaaatacc

SEQ ID NO: 50147 - DNA, 24 bp, Homo sapiens
ttatctatcaggttagtaaatttc

SEQ ID NO: 50148 - DNA, 24 bp, Homo sapiens
tttatctatcaggttagtaaattt

SEQ ID NO: 50149 - DNA, 24 bp, Homo sapiens
ctttatctatcaggttagtaaatt

SEQ ID NO: 50150 - DNA, 24 bp, Homo sapiens
attatactgtggtaagtgttcaga

SEQ ID NO: 50151 - DNA, 24 bp, Homo sapiens
tattatactgtggtaagtgttcag

SEQ ID NO: 50152 - DNA, 24 bp, Homo sapiens
ttattatactgtggtaagtgttca

SEQ ID NO: 50153 - DNA, 23 bp, Homo sapiens
ttgtgttgctgtgaaggaatacc

SEQ ID NO: 50154 - DNA, 24 bp, Homo sapiens
aattgtctcagagttcttcaggct

SEQ ID NO: 50155 - DNA, 25 bp, Homo sapiens
attgatcctcctgcctcagccttct

SEQ ID NO: 50156 - DNA, 23 bp, Homo sapiens
gaactcctgggctcaagcagtcc

SEQ ID NO: 50157 - DNA, 23 bp, Homo sapiens
gacggggtcttgccatgtcacca

SEQ ID NO: 50158 - DNA, 23 bp, Homo sapiens
gcatgcgccgcgaccatggagcg

SEQ ID NO: 50159 - DNA, 24 bp, Homo sapiens
gaagtaaacatagactgcaaatag

SEQ ID NO: 50160 - DNA, 24 bp, Homo sapiens
tgaagtaaacatagactgcaaata

SEQ ID NO: 50161 - DNA, 24 bp, Homo sapiens
atgaagtaaacatagactgcaaat

SEQ ID NO: 50162 - DNA, 24 bp, Homo sapiens
gtgacatcaaggcagaaatcaaat

SEQ ID NO: 50163 - DNA, 24 bp, Homo sapiens
agtgacatcaaggcagaaatcaaa

SEQ ID NO: 50164 - DNA, 24 bp, Homo sapiens
aagtgacatcaaggcagaaatcaa

SEQ ID NO: 50165 - DNA, 24 bp, Homo sapiens
ggaagcaatgggcttctggacttt

SEQ ID NO: 50166 - DNA, 24 bp, Homo sapiens
gggaagcaatgggcttctggactt

SEQ ID NO: 50167 - DNA, 24 bp, Homo sapiens
tgggaagcaatgggcttctggact

SEQ ID NO: 50168 - DNA, 24 bp, Homo sapiens
gaatatatcaggtaggaaataaca

SEQ ID NO: 50169 - DNA, 24 bp, Homo sapiens
agaatatatcaggtaggaaataac

SEQ ID NO: 50170 - DNA, 24 bp, Homo sapiens
tagaatatatcaggtaggaaataa

SEQ ID NO: 50171 - DNA, 24 bp, Homo sapiens
agagcttgctggatggcttaaatt

SEQ ID NO: 50172 - DNA, 24 bp, Homo sapiens
gagagcttgctggatggcttaaat

SEQ ID NO: 50173 - DNA, 24 bp, Homo sapiens
ggagagcttgctggatggcttaaa

SEQ ID NO: 50174 - DNA, 24 bp, Homo sapiens
ttttatcatagttaacagcttaaa

SEQ ID NO: 50175 - DNA, 24 bp, Homo sapiens
tttttatcatagttaacagcttaa

SEQ ID NO: 50176 - DNA, 24 bp, Homo sapiens
ctttttatcatagttaacagctta

SEQ ID NO: 50177 - DNA, 24 bp, Homo sapiens
tctagaagttggtgagcagaatgc

SEQ ID NO: 50178 - DNA, 24 bp, Homo sapiens
ttctagaagttggtgagcagaatg

SEQ ID NO: 50179 - DNA, 24 bp, Homo sapiens
cttctagaagttggtgagcagaat

SEQ ID NO: 50180 - DNA, 23 bp, Homo sapiens
ggcattcaactggcatcctctgg

SEQ ID NO: 50181 - DNA, 24 bp, Homo sapiens
gaatctcccacctcagcctcccaa

SEQ ID NO: 50182 - DNA, 24 bp, Homo sapiens
gcatggagacactcaggagcacaa

SEQ ID NO: 50183 - DNA, 23 bp, Homo sapiens
agttccttcgtggtcctggctgc

SEQ ID NO: 50184 - DNA, 25 bp, Homo sapiens
tgatgtcttccgaaggactgctaca

SEQ ID NO: 50185 - DNA, 25 bp, Homo sapiens
aagtgctggaattacaggcatgagc

SEQ ID NO: 50186 - DNA, 24 bp, Homo sapiens
cgttgccactactctgcctgttct

SEQ ID NO: 50187 - DNA, 24 bp, Homo sapiens
ctgacagccattcgcttgcctgct

SEQ ID NO: 50188 - DNA, 24 bp, Homo sapiens
gagcccacctccagcagcagtcct

SEQ ID NO: 50189 - DNA, 24 bp, Homo sapiens
cagacatgggctgctccgccaaag

SEQ ID NO: 50190 - DNA, 24 bp, Homo sapiens
gtcgccgtccccgtctcctgccag

SEQ ID NO: 50191 - DNA, 24 bp, Homo sapiens
gggctactgtgcgctgtgctgggc

SEQ ID NO: 50192 - DNA, 24 bp, Homo sapiens
aaattctgcaggtaagtaatagcc

SEQ ID NO: 50193 - DNA, 24 bp, Homo sapiens
taaattctgcaggtaagtaatagc

SEQ ID NO: 50194 - DNA, 24 bp, Homo sapiens
ataaattctgcaggtaagtaatag

SEQ ID NO: 50195 - DNA, 24 bp, Homo sapiens
atgaagaagctgtggtggatcagg

SEQ ID NO: 50196 - DNA, 24 bp, Homo sapiens
ccagtacaattctcaacattcact

SEQ ID NO: 50197 - DNA, 24 bp, Homo sapiens
cggacggcgtcctcagctatcaga

SEQ ID NO: 50198 - DNA, 24 bp, Homo sapiens
gcgatgggctggctggtctgatcc

SEQ ID NO: 50199 - DNA, 24 bp, Homo sapiens
tgcgatgggctggctggtctgatc

SEQ ID NO: 50200 - DNA, 24 bp, Homo sapiens
ctgcgatgggctggctggtctgat

SEQ ID NO: 50201 - DNA, 24 bp, Homo sapiens
gaaaatatcaaatctataagtcgt

SEQ ID NO: 50202 - DNA, 24 bp, Homo sapiens
tgaaaatatcaaatctataagtcg

SEQ ID NO: 50203 - DNA, 24 bp, Homo sapiens
ctgaaaatatcaaatctataagtc

SEQ ID NO: 50204 - DNA, 24 bp, Homo sapiens
gcagaagaagccctgggagtccat

SEQ ID NO: 50205 - DNA, 24 bp, Homo sapiens
cctgctgctggtgtactcctatgc

SEQ ID NO: 50206 - DNA, 24 bp, Homo sapiens
acatcgtgttcttgaagacgcaca

SEQ ID NO: 50207 - DNA, 24 bp, Homo sapiens
aaacagggcagagcaggatggaac

SEQ ID NO: 50208 - DNA, 24 bp, Homo sapiens
ctgggtgaggaatatggatgagcc

SEQ ID NO: 50209 - DNA, 24 bp, Homo sapiens
gcccatgggggtcatcaggctggg

SEQ ID NO: 50210 - DNA, 24 bp, Homo sapiens
cctgctgctggtgtactcctatgc

SEQ ID NO: 50211 - DNA, 24 bp, Homo sapiens
acatcgtgttcttgaagacgcaca

SEQ ID NO: 50212 - DNA, 24 bp, Homo sapiens
cctgctcaacatcctgttccgctt

SEQ ID NO: 50213 - DNA, 24 bp, Homo sapiens
gacttataccagcgacaaccacgg

SEQ ID NO: 50214 - DNA, 24 bp, Homo sapiens
gcaatgggttggctgtggtggatt

SEQ ID NO: 50215 - DNA, 24 bp, Homo sapiens
ggtagatggtgaacctccacaaca

SEQ ID NO: 50216 - DNA, 24 bp, Homo sapiens
tgctggcagaatcttcgtccgcac

SEQ ID NO: 50217 - DNA, 24 bp, Homo sapiens
cgtcgctggaagacctgggctggg

SEQ ID NO: 50218 - DNA, 24 bp, Homo sapiens
ctgtcgccgccgccgtcgcagtcg

SEQ ID NO: 50219 - DNA, 24 bp, Homo sapiens
atttcttaaagaatgtaattgacc

SEQ ID NO: 50220 - DNA, 24 bp, Homo sapiens
tatttcttaaagaatgtaattgac

SEQ ID NO: 50221 - DNA, 24 bp, Homo sapiens
ttatttcttaaagaatgtaattga

SEQ ID NO: 50222 - DNA, 24 bp, Homo sapiens
caccttcgaaagtaggtattgaat

SEQ ID NO: 50223 - DNA, 24 bp, Homo sapiens
ccaccttcgaaagtaggtattgaa

SEQ ID NO: 50224 - DNA, 24 bp, Homo sapiens
accaccttcgaaagtaggtattga

SEQ ID NO: 50225 - DNA, 24 bp, Homo sapiens
cggattccaacggcattctgttat

SEQ ID NO: 50226 - DNA, 24 bp, Homo sapiens
tcccaggctcaagtgatcttccca

SEQ ID NO: 50227 - DNA, 24 bp, Homo sapiens
ccagaggccggaactagaattgca

SEQ ID NO: 50228 - DNA, 24 bp, Homo sapiens
gaagccaccaggagcagccaccat

SEQ ID NO: 50229 - DNA, 24 bp, Homo sapiens
ggaagccaccaggagcagccacca

SEQ ID NO: 50230 - DNA, 24 bp, Homo sapiens
aggaagccaccaggagcagccacc

SEQ ID NO: 50231 - DNA, 24 bp, Homo sapiens
aacagtgtggacaggtggcagcgg

SEQ ID NO: 50232 - DNA, 24 bp, Homo sapiens
ccgaccaggctacattcccattcc

SEQ ID NO: 50233 - DNA, 24 bp, Homo sapiens
gatgcagcgattccgaactgaggc

SEQ ID NO: 50234 - DNA, 23 bp, Homo sapiens
gctgtcacctgagattgccgtgg

SEQ ID NO: 50235 - DNA, 23 bp, Homo sapiens
caattcttctgcctcagcgaacc

SEQ ID NO: 50236 - DNA, 23 bp, Homo sapiens
tcagcttactgcagcctctgcct

SEQ ID NO: 50237 - DNA, 24 bp, Homo sapiens
tgaattaaaggaagccgaggagct

SEQ ID NO: 50238 - DNA, 24 bp, Homo sapiens
ttgaattaaaggaagccgaggagc

SEQ ID NO: 50239 - DNA, 24 bp, Homo sapiens
tttgaattaaaggaagccgaggag

SEQ ID NO: 50240 - DNA, 24 bp, Homo sapiens
cctatggcgaggtgcatatcaaga

SEQ ID NO: 50241 - DNA, 24 bp, Homo sapiens
gcctatggcgaggtgcatatcaag

SEQ ID NO: 50242 - DNA, 24 bp, Homo sapiens
ggcctatggcgaggtgcatatcaa

SEQ ID NO: 50243 - DNA, 23 bp, Homo sapiens
gctggagacggtgcctctagtca

SEQ ID NO: 50244 - DNA, 23 bp, Homo sapiens
ctgagcaggagggcagcaggagc

SEQ ID NO: 50245 - DNA, 25 bp, Homo sapiens
ccctgaggacccagatgaggattct

SEQ ID NO: 50246 - DNA, 25 bp, Homo sapiens
gcataccatctcctacacagccgac

SEQ ID NO: 50247 - DNA, 24 bp, Homo sapiens
cgcctctacaagatgctctgccac

SEQ ID NO: 50248 - DNA, 23 bp, Homo sapiens
gtgctggtgctgatggcgcggcg

SEQ ID NO: 50249 - DNA, 23 bp, Homo sapiens
ccgtcaccaccgccatcatccac

SEQ ID NO: 50250 - DNA, 23 bp, Homo sapiens
tcggtgacactcagcatcgtcca

SEQ ID NO: 50251 - DNA, 23 bp, Homo sapiens
acgcccgcgagcagctgggcttc

SEQ ID NO: 50252 - DNA, 24 bp, Homo sapiens
cttcccaccagcagccgcagcacg

SEQ ID NO: 50253 - DNA, 24 bp, Homo sapiens
ccttcccaccagcagccgcagcac

SEQ ID NO: 50254 - DNA, 24 bp, Homo sapiens
cccttcccaccagcagccgcagca

SEQ ID NO: 50255 - DNA, 24 bp, Homo sapiens
gaaaatgaaagacctgagtttggg

SEQ ID NO: 50256 - DNA, 24 bp, Homo sapiens
ggaaaatgaaagacctgagtttgg

SEQ ID NO: 50257 - DNA, 24 bp, Homo sapiens
gggaaaatgaaagacctgagtttg

SEQ ID NO: 50258 - DNA, 24 bp, Homo sapiens
aaagaagaaagatattattttcct

SEQ ID NO: 50259 - DNA, 24 bp, Homo sapiens
aaaagaagaaagatattattttcc

SEQ ID NO: 50260 - DNA, 24 bp, Homo sapiens
aaaaagaagaaagatattattttc

SEQ ID NO: 50261 - DNA, 24 bp, Homo sapiens
taggcaagcaggctgtggcgcaga

SEQ ID NO: 50262 - DNA, 24 bp, Homo sapiens
ttaggcaagcaggctgtggcgcag

SEQ ID NO: 50263 - DNA, 24 bp, Homo sapiens
cttaggcaagcaggctgtggcgca

SEQ ID NO: 50264 - DNA, 23 bp, Homo sapiens
ctggacggctggtggctctgctc

SEQ ID NO: 50265 - DNA, 23 bp, Homo sapiens
gtgcctgggaaccgcctcaagat

SEQ ID NO: 50266 - DNA, 25 bp, Homo sapiens
gcatgtatgataagaagccagcagg

SEQ ID NO: 50267 - DNA, 23 bp, Homo sapiens
ccactgctgcgtgaggagaccta

SEQ ID NO: 50268 - DNA, 23 bp, Homo sapiens
cggctcctgacctctacgacgtg

SEQ ID NO: 50269 - DNA, 23 bp, Homo sapiens
ctgaggtggctgatggtggcgtg

SEQ ID NO: 50270 - DNA, 23 bp, Homo sapiens
ctatgaccgccacccagccctcc

SEQ ID NO: 50271 - DNA, 23 bp, Homo sapiens
cgccacaaggtgaagtcccaggg

SEQ ID NO: 50272 - DNA, 23 bp, Homo sapiens
cattgcccccacccccattttcc

SEQ ID NO: 50273 - DNA, 23 bp, Homo sapiens
tgtccaaactgaacgccgaggtg

SEQ ID NO: 50274 - DNA, 23 bp, Homo sapiens
accagcctcgtgtctgccttaga

SEQ ID NO: 50275 - DNA, 23 bp, Homo sapiens
ggacccgaccgctggaactccgc

SEQ ID NO: 50276 - DNA, 24 bp, Homo sapiens
tttttgtacagtagtagaaaacga

SEQ ID NO: 50277 - DNA, 24 bp, Homo sapiens
ttttttgtacagtagtagaaaacg

SEQ ID NO: 50278 - DNA, 24 bp, Homo sapiens
cttttttgtacagtagtagaaaac

SEQ ID NO: 50279 - DNA, 24 bp, Homo sapiens
tctctctccaggtggcgtcatcac

SEQ ID NO: 50280 - DNA, 24 bp, Homo sapiens
ttctctctccaggtggcgtcatca

SEQ ID NO: 50281 - DNA, 24 bp, Homo sapiens
gttctctctccaggtggcgtcatc

SEQ ID NO: 50282 - DNA, 24 bp, Homo sapiens
catttcatcagagtatctagaaac

SEQ ID NO: 50283 - DNA, 24 bp, Homo sapiens
tcatttcatcagagtatctagaaa

SEQ ID NO: 50284 - DNA, 24 bp, Homo sapiens
ttcatttcatcagagtatctagaa

SEQ ID NO: 50285 - DNA, 24 bp, Homo sapiens
ttcttttgtagaagcaagagataa

SEQ ID NO: 50286 - DNA, 24 bp, Homo sapiens
cttcttttgtagaagcaagagata

SEQ ID NO: 50287 - DNA, 24 bp, Homo sapiens
ccttcttttgtagaagcaagagat

SEQ ID NO: 50288 - DNA, 24 bp, Homo sapiens
aaaagagcaaaaagagagagcaac

SEQ ID NO: 50289 - DNA, 24 bp, Homo sapiens
caaaagagcaaaaagagagagcaa

SEQ ID NO: 50290 - DNA, 24 bp, Homo sapiens
ccaaaagagcaaaaagagagagca

SEQ ID NO: 50291 - DNA, 23 bp, Homo sapiens
ggcagagggcagagggcagagag

SEQ ID NO: 50292 - DNA, 23 bp, Homo sapiens
gacgagtcgcagagcaggaccgc

SEQ ID NO: 50293 - DNA, 23 bp, Homo sapiens
cctcccagcccagcctccccaac

SEQ ID NO: 50294 - DNA, 23 bp, Homo sapiens
cactcggagcagaagaacatggc

SEQ ID NO: 50295 - DNA, 24 bp, Homo sapiens
ttgagaagcagcagcagcagatgg

SEQ ID NO: 50296 - DNA, 25 bp, Homo sapiens
caacctccttcagcagcagatccag

SEQ ID NO: 50297 - DNA, 24 bp, Homo sapiens
ttgagaagcagcagcagcagatgg

SEQ ID NO: 50298 - DNA, 23 bp, Homo sapiens
cactcggagcagaagaacatggc

SEQ ID NO: 50299 - DNA, 23 bp, Homo sapiens
ccaccctgcgggaccagctcctg

SEQ ID NO: 50300 - DNA, 24 bp, Homo sapiens
aaatttcaaaggcatttcagaatt

SEQ ID NO: 50301 - DNA, 24 bp, Homo sapiens
gaaatttcaaaggcatttcagaat

SEQ ID NO: 50302 - DNA, 24 bp, Homo sapiens
agaaatttcaaaggcatttcagaa

SEQ ID NO: 50303 - DNA, 24 bp, Homo sapiens
tcaatcataaggaggaaaaaaagc

SEQ ID NO: 50304 - DNA, 24 bp, Homo sapiens
gtcaatcataaggaggaaaaaaag

SEQ ID NO: 50305 - DNA, 24 bp, Homo sapiens
tgtcaatcataaggaggaaaaaaa

SEQ ID NO: 50306 - DNA, 24 bp, Homo sapiens
gaaacagaaaagtaagctaaatgt

SEQ ID NO: 50307 - DNA, 24 bp, Homo sapiens
agaaacagaaaagtaagctaaatg

SEQ ID NO: 50308 - DNA, 24 bp, Homo sapiens
aagaaacagaaaagtaagctaaat

SEQ ID NO: 50309 - DNA, 24 bp, Homo sapiens
ttgaaactgaagaaacacataatt

SEQ ID NO: 50310 - DNA, 24 bp, Homo sapiens
gttgaaactgaagaaacacataat

SEQ ID NO: 50311 - DNA, 24 bp, Homo sapiens
agttgaaactgaagaaacacataa

SEQ ID NO: 50312 - DNA, 25 bp, Homo sapiens
ttaggaacatagctctccagactgt

SEQ ID NO: 50313 - DNA, 25 bp, Homo sapiens
tctgtgccaaatgtgatactttaat

SEQ ID NO: 50314 - DNA, 23 bp, Homo sapiens
ctacgcacacacacagacgcaca

SEQ ID NO: 50315 - DNA, 24 bp, Homo sapiens
caccaactcagagaaattaatgga

SEQ ID NO: 50316 - DNA, 24 bp, Homo sapiens
tcaccaactcagagaaattaatgg

SEQ ID NO: 50317 - DNA, 24 bp, Homo sapiens
gtcaccaactcagagaaattaatg

SEQ ID NO: 50318 - DNA, 24 bp, Homo sapiens
tttaatactaggagttcgcagtcc

SEQ ID NO: 50319 - DNA, 24 bp, Homo sapiens
ttttaatactaggagttcgcagtc

SEQ ID NO: 50320 - DNA, 24 bp, Homo sapiens
attttaatactaggagttcgcagt

SEQ ID NO: 50321 - DNA, 24 bp, Homo sapiens
aacaaaagagatatcttctcacag

SEQ ID NO: 50322 - DNA, 24 bp, Homo sapiens
aaacaaaagagatatcttctcaca

SEQ ID NO: 50323 - DNA, 24 bp, Homo sapiens
aaaacaaaagagatatcttctcac

SEQ ID NO: 50324 - DNA, 25 bp, Homo sapiens
aagccctcgtcagaaggaattatgg

SEQ ID NO: 50325 - DNA, 25 bp, Homo sapiens
ttgtattactatttaaccaagaaaa

SEQ ID NO: 50326 - DNA, 24 bp, Homo sapiens
gggtccccgaggcatcatcgacct

SEQ ID NO: 50327 - DNA, 24 bp, Homo sapiens
cgggtccccgaggcatcatcgacc

SEQ ID NO: 50328 - DNA, 24 bp, Homo sapiens
gcgggtccccgaggcatcatcgac

SEQ ID NO: 50329 - DNA, 24 bp, Homo sapiens
caagcagccaggccccgtgaagct

SEQ ID NO: 50330 - DNA, 24 bp, Homo sapiens
ccaagcagccaggccccgtgaagc

SEQ ID NO: 50331 - DNA, 24 bp, Homo sapiens
cccaagcagccaggccccgtgaag

SEQ ID NO: 50332 - DNA, 23 bp, Homo sapiens
gccaccctctgtctcctcagtgc

SEQ ID NO: 50333 - DNA, 23 bp, Homo sapiens
gcagacccagcagccgaaaagcc

SEQ ID NO: 50334 - DNA, 23 bp, Homo sapiens
ggagactgcaaccgccggacgcc

SEQ ID NO: 50335 - DNA, 24 bp, Homo sapiens
gtgatattaaggaatttttatgtg

SEQ ID NO: 50336 - DNA, 24 bp, Homo sapiens
cgtgatattaaggaatttttatgt

SEQ ID NO: 50337 - DNA, 24 bp, Homo sapiens
tcgtgatattaaggaatttttatg

SEQ ID NO: 50338 - DNA, 23 bp, Homo sapiens
cccgcagctcaagcctcgtcccc

SEQ ID NO: 50339 - DNA, 23 bp, Homo sapiens
ccgccgccgccgccgccgccgcc

SEQ ID NO: 50340 - DNA, 23 bp, Homo sapiens
cagccggagcccaagcgcagccc

SEQ ID NO: 50341 - DNA, 23 bp, Homo sapiens
gaccaagagccagggagccagat

SEQ ID NO: 50342 - DNA, 25 bp, Homo sapiens
acgacctcatgctcatcaagttgga

SEQ ID NO: 50343 - DNA, 23 bp, Homo sapiens
gggaactcttgcctcgtttctgg

SEQ ID NO: 50344 - DNA, 24 bp, Homo sapiens
actcctgcaacgggtccaggcccc

SEQ ID NO: 50345 - DNA, 24 bp, Homo sapiens
gactcctgcaacgggtccaggccc

SEQ ID NO: 50346 - DNA, 24 bp, Homo sapiens
ggactcctgcaacgggtccaggcc

SEQ ID NO: 50347 - DNA, 24 bp, Homo sapiens
aaacaatgatggggaattgacttt

SEQ ID NO: 50348 - DNA, 24 bp, Homo sapiens
taaacaatgatggggaattgactt

SEQ ID NO: 50349 - DNA, 24 bp, Homo sapiens
ataaacaatgatggggaattgact

SEQ ID NO: 50350 - DNA, 24 bp, Homo sapiens
cagctaaaggaacaaacagtagaa

SEQ ID NO: 50351 - DNA, 24 bp, Homo sapiens
gcagctaaaggaacaaacagtaga

SEQ ID NO: 50352 - DNA, 24 bp, Homo sapiens
agcagctaaaggaacaaacagtag

SEQ ID NO: 50353 - DNA, 24 bp, Homo sapiens
agacttaatgggaaaacttagcaa

SEQ ID NO: 50354 - DNA, 24 bp, Homo sapiens
cagacttaatgggaaaacttagca

SEQ ID NO: 50355 - DNA, 24 bp, Homo sapiens
tcagacttaatgggaaaacttagc

SEQ ID NO: 50356 - DNA, 24 bp, Homo sapiens
aaaacataaaggtaagggaaaatt

SEQ ID NO: 50357 - DNA, 24 bp, Homo sapiens
caaaacataaaggtaagggaaaat

SEQ ID NO: 50358 - DNA, 24 bp, Homo sapiens
tcaaaacataaaggtaagggaaaa

SEQ ID NO: 50359 - DNA, 24 bp, Homo sapiens
ggaaatccaaatactactgctaaa

SEQ ID NO: 50360 - DNA, 24 bp, Homo sapiens
aggaaatccaaatactactgctaa

SEQ ID NO: 50361 - DNA, 24 bp, Homo sapiens
taggaaatccaaatactactgcta

SEQ ID NO: 50362 - DNA, 24 bp, Homo sapiens
gacatggctaagcaggctcaggtg

SEQ ID NO: 50363 - DNA, 23 bp, Homo sapiens
gcagtcatcaaaccgctggcaag

SEQ ID NO: 50364 - DNA, 25 bp, Homo sapiens
ccagaggaggcttcaccgtatgttg

SEQ ID NO: 50365 - DNA, 24 bp, Homo sapiens
tttaatttcagctacaagctatga

SEQ ID NO: 50366 - DNA, 24 bp, Homo sapiens
ttttaatttcagctacaagctatg

SEQ ID NO: 50367 - DNA, 24 bp, Homo sapiens
tttttaatttcagctacaagctat

SEQ ID NO: 50368 - DNA, 24 bp, Homo sapiens
aaagtgacaaggttagtacttttt

SEQ ID NO: 50369 - DNA, 24 bp, Homo sapiens
taaagtgacaaggttagtactttt

SEQ ID NO: 50370 - DNA, 24 bp, Homo sapiens
ttaaagtgacaaggttagtacttt

SEQ ID NO: 50371 - DNA, 23 bp, Homo sapiens
agggtgccatccgtgacttctcg

SEQ ID NO: 50372 - DNA, 24 bp, Homo sapiens
acaagcagaaggagcagcgagaac

SEQ ID NO: 50373 - DNA, 25 bp, Homo sapiens
aaagaggcggaaagagaaagggctg

SEQ ID NO: 50374 - DNA, 23 bp, Homo sapiens
ctgtaccctgcggctatgcggtg

SEQ ID NO: 50375 - DNA, 23 bp, Homo sapiens
cctcctgctgcccgcctactcca

SEQ ID NO: 50376 - DNA, 25 bp, Homo sapiens
ccagaagtcacagaagatcgccagc

SEQ ID NO: 50377 - DNA, 24 bp, Homo sapiens
gcgctgtgtggtggccggcatgaa

SEQ ID NO: 50378 - DNA, 24 bp, Homo sapiens
tgcgctgtgtggtggccggcatga

SEQ ID NO: 50379 - DNA, 24 bp, Homo sapiens
ctgcgctgtgtggtggccggcatg

SEQ ID NO: 50380 - DNA, 24 bp, Homo sapiens
ttttcccacaggtatacataatca

SEQ ID NO: 50381 - DNA, 24 bp, Homo sapiens
tttttcccacaggtatacataatc

SEQ ID NO: 50382 - DNA, 24 bp, Homo sapiens
ctttttcccacaggtatacataat

SEQ ID NO: 50383 - DNA, 24 bp, Homo sapiens
atggcagtgccgggttccaactgc

SEQ ID NO: 50384 - DNA, 24 bp, Homo sapiens
aatggcagtgccgggttccaactg

SEQ ID NO: 50385 - DNA, 24 bp, Homo sapiens
caatggcagtgccgggttccaact

SEQ ID NO: 50386 - DNA, 24 bp, Homo sapiens
tccaaaaatcagtatgaatttatt

SEQ ID NO: 50387 - DNA, 24 bp, Homo sapiens
ttccaaaaatcagtatgaatttat

SEQ ID NO: 50388 - DNA, 24 bp, Homo sapiens
cttccaaaaatcagtatgaattta

SEQ ID NO: 50389 - DNA, 24 bp, Homo sapiens
tccaaaaatcagagacttgtatgg

SEQ ID NO: 50390 - DNA, 24 bp, Homo sapiens
ttccaaaaatcagagacttgtatg

SEQ ID NO: 50391 - DNA, 24 bp, Homo sapiens
cttccaaaaatcagagacttgtat

SEQ ID NO: 50392 - DNA, 24 bp, Homo sapiens
aatcattacaggtaaagcttgcat

SEQ ID NO: 50393 - DNA, 24 bp, Homo sapiens
aaatcattacaggtaaagcttgca

SEQ ID NO: 50394 - DNA, 24 bp, Homo sapiens
aaaatcattacaggtaaagcttgc

SEQ ID NO: 50395 - DNA, 24 bp, Homo sapiens
ctgggcagcaggaaggccccgcca

SEQ ID NO: 50396 - DNA, 24 bp, Homo sapiens
tctgggcagcaggaaggccccgcc

SEQ ID NO: 50397 - DNA, 24 bp, Homo sapiens
ttctgggcagcaggaaggccccgc

SEQ ID NO: 50398 - DNA, 23 bp, Homo sapiens
ttaaccgcctttgggaagtcgcc

SEQ ID NO: 50399 - DNA, 23 bp, Homo sapiens
cggcagtggctggtctccatcca

SEQ ID NO: 50400 - DNA, 23 bp, Homo sapiens
ggaacactcgccgcaagatggag

SEQ ID NO: 50401 - DNA, 24 bp, Homo sapiens
aaagctataagtgtgaaacaataa

SEQ ID NO: 50402 - DNA, 24 bp, Homo sapiens
gaaagctataagtgtgaaacaata

SEQ ID NO: 50403 - DNA, 24 bp, Homo sapiens
agaaagctataagtgtgaaacaat

SEQ ID NO: 50404 - DNA, 24 bp, Homo sapiens
gggctggaaagccccaccggcccg

SEQ ID NO: 50405 - DNA, 24 bp, Homo sapiens
agggctggaaagccccaccggccc

SEQ ID NO: 50406 - DNA, 24 bp, Homo sapiens
cagggctggaaagccccaccggcc

SEQ ID NO: 50407 - DNA, 24 bp, Homo sapiens
accgtggggagatcatcgacccct

SEQ ID NO: 50408 - DNA, 24 bp, Homo sapiens
gaccgtggggagatcatcgacccc

SEQ ID NO: 50409 - DNA, 24 bp, Homo sapiens
ggaccgtggggagatcatcgaccc

SEQ ID NO: 50410 - DNA, 24 bp, Homo sapiens
agatgttcagggaagcggacacgg

SEQ ID NO: 50411 - DNA, 24 bp, Homo sapiens
cagatgttcagggaagcggacacg

SEQ ID NO: 50412 - DNA, 24 bp, Homo sapiens
gcagatgttcagggaagcggacac

SEQ ID NO: 50413 - DNA, 23 bp, Homo sapiens
ctcgctggacagtcatgctgctg

SEQ ID NO: 50414 - DNA, 23 bp, Homo sapiens
tacacgggacacaggctccaagg

SEQ ID NO: 50415 - DNA, 23 bp, Homo sapiens
gcctggaaaccatcgctgaggag

SEQ ID NO: 50416 - DNA, 24 bp, Homo sapiens
tcctaaaagaagaaaagatacctt

SEQ ID NO: 50417 - DNA, 24 bp, Homo sapiens
ttcctaaaagaagaaaagatacct

SEQ ID NO: 50418 - DNA, 24 bp, Homo sapiens
tttcctaaaagaagaaaagatacc

SEQ ID NO: 50419 - DNA, 24 bp, Homo sapiens
gattcatttatgcaaattctgttt

SEQ ID NO: 50420 - DNA, 24 bp, Homo sapiens
tgattcatttatgcaaattctgtt

SEQ ID NO: 50421 - DNA, 24 bp, Homo sapiens
ttgattcatttatgcaaattctgt

SEQ ID NO: 50422 - DNA, 23 bp, Homo sapiens
tccagccaccaccacctcagatg

SEQ ID NO: 50423 - DNA, 24 bp, Homo sapiens
ttagccttcaagacgcactgagca

SEQ ID NO: 50424 - DNA, 25 bp, Homo sapiens
tgaccgaccctgagcaagagaagaa

SEQ ID NO: 50425 - DNA, 24 bp, Homo sapiens
ttttgccttagaaataataaacat

SEQ ID NO: 50426 - DNA, 24 bp, Homo sapiens
cttttgccttagaaataataaaca

SEQ ID NO: 50427 - DNA, 24 bp, Homo sapiens
ccttttgccttagaaataataaac

SEQ ID NO: 50428 - DNA, 24 bp, Homo sapiens
gccatgtactccagccttgtgacc

SEQ ID NO: 50429 - DNA, 23 bp, Homo sapiens
gcctcattcctccaagtccacgg

SEQ ID NO: 50430 - DNA, 25 bp, Homo sapiens
agtcagagatgtatcctggtggagc

SEQ ID NO: 50431 - DNA, 24 bp, Homo sapiens
tgggttgtgtgggtcctggtgcct

SEQ ID NO: 50432 - DNA, 24 bp, Homo sapiens
ctgggttgtgtgggtcctggtgcc

SEQ ID NO: 50433 - DNA, 24 bp, Homo sapiens
tctgggttgtgtgggtcctggtgc

SEQ ID NO: 50434 - DNA, 24 bp, Homo sapiens
tgagacagctgtcccccatgagga

SEQ ID NO: 50435 - DNA, 24 bp, Homo sapiens
atgagacagctgtcccccatgagg

SEQ ID NO: 50436 - DNA, 24 bp, Homo sapiens
catgagacagctgtcccccatgag

SEQ ID NO: 50437 - DNA, 24 bp, Homo sapiens
tttattcctagaaagagattaaaa

SEQ ID NO: 50438 - DNA, 24 bp, Homo sapiens
ttttattcctagaaagagattaaa

SEQ ID NO: 50439 - DNA, 24 bp, Homo sapiens
tttttattcctagaaagagattaa

SEQ ID NO: 50440 - DNA, 24 bp, Homo sapiens
ttctcccatagattgatatagaaa

SEQ ID NO: 50441 - DNA, 24 bp, Homo sapiens
tttctcccatagattgatatagaa

SEQ ID NO: 50442 - DNA, 24 bp, Homo sapiens
gtttctcccatagattgatataga

SEQ ID NO: 50443 - DNA, 24 bp, Homo sapiens
tttttaaccaggttttcactaatg

SEQ ID NO: 50444 - DNA, 24 bp, Homo sapiens
ctttttaaccaggttttcactaat

SEQ ID NO: 50445 - DNA, 24 bp, Homo sapiens
tctttttaaccaggttttcactaa

SEQ ID NO: 50446 - DNA, 24 bp, Homo sapiens
gagacgggcaggaggacatggaag

SEQ ID NO: 50447 - DNA, 24 bp, Homo sapiens
agagacgggcaggaggacatggaa

SEQ ID NO: 50448 - DNA, 24 bp, Homo sapiens
cagagacgggcaggaggacatgga

SEQ ID NO: 50449 - DNA, 24 bp, Homo sapiens
gaagaatttaagcacatagcagta

SEQ ID NO: 50450 - DNA, 24 bp, Homo sapiens
agaagaatttaagcacatagcagt

SEQ ID NO: 50451 - DNA, 24 bp, Homo sapiens
aagaagaatttaagcacatagcag

SEQ ID NO: 50452 - DNA, 24 bp, Homo sapiens
acctatccctgatcagccggcagt

SEQ ID NO: 50453 - DNA, 24 bp, Homo sapiens
aacctatccctgatcagccggcag

SEQ ID NO: 50454 - DNA, 24 bp, Homo sapiens
gaacctatccctgatcagccggca

SEQ ID NO: 50455 - DNA, 25 bp, Homo sapiens
aggaggaggaggaggaagaagagga

SEQ ID NO: 50456 - DNA, 25 bp, Homo sapiens
aagtgaagaagaggaggaagaggag

SEQ ID NO: 50457 - DNA, 25 bp, Homo sapiens
agtgaaggcagtgaaggtgatgagg

SEQ ID NO: 50458 - DNA, 24 bp, Homo sapiens
ggagtggaatatcagtgtccttag

SEQ ID NO: 50459 - DNA, 24 bp, Homo sapiens
gggagtggaatatcagtgtcctta

SEQ ID NO: 50460 - DNA, 24 bp, Homo sapiens
ggggagtggaatatcagtgtcctt

SEQ ID NO: 50461 - DNA, 23 bp, Homo sapiens
caccgctgctgctgctgctgctg

SEQ ID NO: 50462 - DNA, 23 bp, Homo sapiens
cgcaccgtgccggggccgcccac

SEQ ID NO: 50463 - DNA, 23 bp, Homo sapiens
ccgcgccgccgccatgaagccgg

SEQ ID NO: 50464 - DNA, 24 bp, Homo sapiens
taatgaagaaggtaacttgtttat

SEQ ID NO: 50465 - DNA, 24 bp, Homo sapiens
ataatgaagaaggtaacttgttta

SEQ ID NO: 50466 - DNA, 24 bp, Homo sapiens
gataatgaagaaggtaacttgttt

SEQ ID NO: 50467 - DNA, 24 bp, Homo sapiens
tgcctctttagattcacagaagtc

SEQ ID NO: 50468 - DNA, 24 bp, Homo sapiens
ctgcctctttagattcacagaagt

SEQ ID NO: 50469 - DNA, 24 bp, Homo sapiens
tctgcctctttagattcacagaag

SEQ ID NO: 50470 - DNA, 24 bp, Homo sapiens
ttctgagtaaggtatgtataaatt

SEQ ID NO: 50471 - DNA, 24 bp, Homo sapiens
attctgagtaaggtatgtataaat

SEQ ID NO: 50472 - DNA, 24 bp, Homo sapiens
aattctgagtaaggtatgtataaa

SEQ ID NO: 50473 - DNA, 24 bp, Homo sapiens
aaacacccaaggttttttgctctg

SEQ ID NO: 50474 - DNA, 24 bp, Homo sapiens
gaaacacccaaggttttttgctct

SEQ ID NO: 50475 - DNA, 24 bp, Homo sapiens
tgaaacacccaaggttttttgctc

SEQ ID NO: 50476 - DNA, 24 bp, Homo sapiens
gtactttatagttgtgggatttgt

SEQ ID NO: 50477 - DNA, 24 bp, Homo sapiens
agtactttatagttgtgggatttg

SEQ ID NO: 50478 - DNA, 24 bp, Homo sapiens
cagtactttatagttgtgggattt

SEQ ID NO: 50479 - DNA, 24 bp, Homo sapiens
gtactttataggcaagtaatgaaa

SEQ ID NO: 50480 - DNA, 24 bp, Homo sapiens
agtactttataggcaagtaatgaa

SEQ ID NO: 50481 - DNA, 24 bp, Homo sapiens
cagtactttataggcaagtaatga

SEQ ID NO: 50482 - DNA, 24 bp, Homo sapiens
ttatttcacaggaagatgaaaatg

SEQ ID NO: 50483 - DNA, 24 bp, Homo sapiens
tttatttcacaggaagatgaaaat

SEQ ID NO: 50484 - DNA, 24 bp, Homo sapiens
atttatttcacaggaagatgaaaa

SEQ ID NO: 50485 - DNA, 24 bp, Homo sapiens
cattgttcaaggtaattagatttc

SEQ ID NO: 50486 - DNA, 24 bp, Homo sapiens
ccattgttcaaggtaattagattt

SEQ ID NO: 50487 - DNA, 24 bp, Homo sapiens
cccattgttcaaggtaattagatt

SEQ ID NO: 50488 - DNA, 24 bp, Homo sapiens
tttacagaagggtaagaattatat

SEQ ID NO: 50489 - DNA, 24 bp, Homo sapiens
atttacagaagggtaagaattata

SEQ ID NO: 50490 - DNA, 24 bp, Homo sapiens
gatttacagaagggtaagaattat

SEQ ID NO: 50491 - DNA, 24 bp, Homo sapiens
attgcacacaggtttgggtttgta

SEQ ID NO: 50492 - DNA, 24 bp, Homo sapiens
cattgcacacaggtttgggtttgt

SEQ ID NO: 50493 - DNA, 24 bp, Homo sapiens
ccattgcacacaggtttgggtttg

SEQ ID NO: 50494 - DNA, 24 bp, Homo sapiens
cctgaaacacaactataaataggt

SEQ ID NO: 50495 - DNA, 24 bp, Homo sapiens
tcctgaaacacaactataaatagg

SEQ ID NO: 50496 - DNA, 24 bp, Homo sapiens
ctcctgaaacacaactataaatag

SEQ ID NO: 50497 - DNA, 24 bp, Homo sapiens
tgctggagttggtgctgctcattt

SEQ ID NO: 50498 - DNA, 24 bp, Homo sapiens
gtgctggagttggtgctgctcatt

SEQ ID NO: 50499 - DNA, 24 bp, Homo sapiens
agtgctggagttggtgctgctcat

SEQ ID NO: 50500 - DNA, 24 bp, Homo sapiens
tgctcttcttggtttctctgggaa

SEQ ID NO: 50501 - DNA, 24 bp, Homo sapiens
atgctcttcttggtttctctggga

SEQ ID NO: 50502 - DNA, 24 bp, Homo sapiens
aatgctcttcttggtttctctggg

SEQ ID NO: 50503 - DNA, 24 bp, Homo sapiens
tcagcaggcaggaccagcttctga

SEQ ID NO: 50504 - DNA, 24 bp, Homo sapiens
ctcagcaggcaggaccagcttctg

SEQ ID NO: 50505 - DNA, 24 bp, Homo sapiens
gctcagcaggcaggaccagcttct

SEQ ID NO: 50506 - DNA, 23 bp, Homo sapiens
tggtggaccgattgctcaactgc

SEQ ID NO: 50507 - DNA, 25 bp, Homo sapiens
gcactgttcataacctctattctca

SEQ ID NO: 50508 - DNA, 23 bp, Homo sapiens
gctagacacggaggcacagacaa

SEQ ID NO: 50509 - DNA, 25 bp, Homo sapiens
accagcaacccttcctctacttcca

SEQ ID NO: 50510 - DNA, 23 bp, Homo sapiens
cgctgccatgctgtccatgtagc

SEQ ID NO: 50511 - DNA, 23 bp, Homo sapiens
cttgcttgcggcggctgaacttc

SEQ ID NO: 50512 - DNA, 23 bp, Homo sapiens
cttgcttgcggcggctgaacttc

SEQ ID NO: 50513 - DNA, 25 bp, Homo sapiens
atgacggaagtagaaagcctggagt

SEQ ID NO: 50514 - DNA, 25 bp, Homo sapiens
tgccaagaatgctgacaaggtactg

SEQ ID NO: 50515 - DNA, 24 bp, Homo sapiens
aagtaaaaaaggtatgagtaataa

SEQ ID NO: 50516 - DNA, 24 bp, Homo sapiens
gaagtaaaaaaggtatgagtaata

SEQ ID NO: 50517 - DNA, 24 bp, Homo sapiens
tgaagtaaaaaaggtatgagtaat

SEQ ID NO: 50518 - DNA, 24 bp, Homo sapiens
gcaatcatcaggtaagagagcaca

SEQ ID NO: 50519 - DNA, 24 bp, Homo sapiens
tgcaatcatcaggtaagagagcac

SEQ ID NO: 50520 - DNA, 24 bp, Homo sapiens
ttgcaatcatcaggtaagagagca

SEQ ID NO: 50521 - DNA, 24 bp, Homo sapiens
aggaaaggtggcagtggcaatcag

SEQ ID NO: 50522 - DNA, 24 bp, Homo sapiens
ttcccgccgtgtccctttatcctt

SEQ ID NO: 50523 - DNA, 24 bp, Homo sapiens
gcagcagccaccaccagcacataa

SEQ ID NO: 50524 - DNA, 24 bp, Homo sapiens
gttttatactattttggcaagcgt

SEQ ID NO: 50525 - DNA, 24 bp, Homo sapiens
agttttatactattttggcaagcg

SEQ ID NO: 50526 - DNA, 24 bp, Homo sapiens
aagttttatactattttggcaagc

SEQ ID NO: 50527 - DNA, 24 bp, Homo sapiens
tgtgtatctagtttggatcatata

SEQ ID NO: 50528 - DNA, 24 bp, Homo sapiens
atgtgtatctagtttggatcatat

SEQ ID NO: 50529 - DNA, 24 bp, Homo sapiens
tatgtgtatctagtttggatcata

SEQ ID NO: 50530 - DNA, 25 bp, Homo sapiens
acacagttagcagaagagccaggat

SEQ ID NO: 50531 - DNA, 23 bp, Homo sapiens
ttagtcaggcgtggtggtgagca

SEQ ID NO: 50532 - DNA, 23 bp, Homo sapiens
gttccagaccagcctgaccaacg

SEQ ID NO: 50533 - DNA, 23 bp, Homo sapiens
ctccagcagacagcagcctcact

SEQ ID NO: 50534 - DNA, 24 bp, Homo sapiens
agatgctgctcagtccaaatgcct

SEQ ID NO: 50535 - DNA, 23 bp, Homo sapiens
gcagcttctggactctgtgaggc

SEQ ID NO: 50536 - DNA, 23 bp, Homo sapiens
cctccagaagtcctccaaggctt

SEQ ID NO: 50537 - DNA, 25 bp, Homo sapiens
tagcctcccgtcaaacaacctctca

SEQ ID NO: 50538 - DNA, 23 bp, Homo sapiens
ctgctgctgtctgtgcttcggga

SEQ ID NO: 50539 - DNA, 23 bp, Homo sapiens
agagcacgagaacctagaccgcc

SEQ ID NO: 50540 - DNA, 23 bp, Homo sapiens
aagatggcggcggcgtctgtctc

SEQ ID NO: 50541 - DNA, 23 bp, Homo sapiens
gtttccaagcccagcaccagcac

SEQ ID NO: 50542 - DNA, 24 bp, Homo sapiens
tatacctcaaggtaaaatgaaaga

SEQ ID NO: 50543 - DNA, 24 bp, Homo sapiens
ttatacctcaaggtaaaatgaaag

SEQ ID NO: 50544 - DNA, 24 bp, Homo sapiens
cttatacctcaaggtaaaatgaaa

SEQ ID NO: 50545 - DNA, 24 bp, Homo sapiens
cagacagtgaaagtgccatccgac

SEQ ID NO: 50546 - DNA, 23 bp, Homo sapiens
aggaggaggaggaggatacgcca

SEQ ID NO: 50547 - DNA, 25 bp, Homo sapiens
cacggcatccaagattccttacagc

SEQ ID NO: 50548 - DNA, 24 bp, Homo sapiens
ttcagacccagatcacatctatgg

SEQ ID NO: 50549 - DNA, 24 bp, Homo sapiens
cttcagacccagatcacatctatg

SEQ ID NO: 50550 - DNA, 24 bp, Homo sapiens
acttcagacccagatcacatctat

SEQ ID NO: 50551 - DNA, 24 bp, Homo sapiens
agttgtggaagaaaataataaaat

SEQ ID NO: 50552 - DNA, 24 bp, Homo sapiens
gagttgtggaagaaaataataaaa

SEQ ID NO: 50553 - DNA, 24 bp, Homo sapiens
agagttgtggaagaaaataataaa

SEQ ID NO: 50554 - DNA, 24 bp, Homo sapiens
agtaaaaaaatgtgagtatccatt

SEQ ID NO: 50555 - DNA, 24 bp, Homo sapiens
cagtaaaaaaatgtgagtatccat

SEQ ID NO: 50556 - DNA, 24 bp, Homo sapiens
ccagtaaaaaaatgtgagtatcca

SEQ ID NO: 50557 - DNA, 24 bp, Homo sapiens
aatggatataggtaagaaaaatgt

SEQ ID NO: 50558 - DNA, 24 bp, Homo sapiens
caatggatataggtaagaaaaatg

SEQ ID NO: 50559 - DNA, 24 bp, Homo sapiens
ccaatggatataggtaagaaaaat

SEQ ID NO: 50560 - DNA, 23 bp, Homo sapiens
atgcgttacagaaggtccagccg

SEQ ID NO: 50561 - DNA, 23 bp, Homo sapiens
ttgctgaggtcatcgtgccagaa

SEQ ID NO: 50562 - DNA, 23 bp, Homo sapiens
agtggcggcggcttatctggcat

SEQ ID NO: 50563 - DNA, 24 bp, Homo sapiens
gcagagcctggagtcttacctgtc

SEQ ID NO: 50564 - DNA, 24 bp, Homo sapiens
agccactctttgaaggactcgccc

SEQ ID NO: 50565 - DNA, 24 bp, Homo sapiens
ggcaggttgatgggtccagagtct

SEQ ID NO: 50566 - DNA, 24 bp, Homo sapiens
attacacaaaagtaagaaaatgct

SEQ ID NO: 50567 - DNA, 24 bp, Homo sapiens
aattacacaaaagtaagaaaatgc

SEQ ID NO: 50568 - DNA, 24 bp, Homo sapiens
aaattacacaaaagtaagaaaatg

SEQ ID NO: 50569 - DNA, 24 bp, Homo sapiens
ccatagcggcggcaggaggtgtcg

SEQ ID NO: 50570 - DNA, 24 bp, Homo sapiens
tcctcttggaagggaaacaatggg

SEQ ID NO: 50571 - DNA, 24 bp, Homo sapiens
ctctgtccgctgcccacagcctag

SEQ ID NO: 50572 - DNA, 24 bp, Homo sapiens
gcaaagaaattgcagatgccatct

SEQ ID NO: 50573 - DNA, 24 bp, Homo sapiens
agcaaagaaattgcagatgccatc

SEQ ID NO: 50574 - DNA, 24 bp, Homo sapiens
aagcaaagaaattgcagatgccat

SEQ ID NO: 50575 - DNA, 25 bp, Homo sapiens
aggatggatggcagatggcaatgtt

SEQ ID NO: 50576 - DNA, 25 bp, Homo sapiens
tggtcatctggaagaggatcggagc

SEQ ID NO: 50577 - DNA, 23 bp, Homo sapiens
cctggttcctgctggttctggca

SEQ ID NO: 50578 - DNA, 23 bp, Homo sapiens
tcaagtgctaccaggggaccgac

SEQ ID NO: 50579 - DNA, 23 bp, Homo sapiens
cgtggttgcgatccgttggtgaa

SEQ ID NO: 50580 - DNA, 23 bp, Homo sapiens
ccaggaccagccaggcaccaact

SEQ ID NO: 50581 - DNA, 24 bp, Homo sapiens
ccctagttccctctgctcagccaa

SEQ ID NO: 50582 - DNA, 24 bp, Homo sapiens
ggaagtaacaaagaatatgcacag

SEQ ID NO: 50583 - DNA, 24 bp, Homo sapiens
tggaagtaacaaagaatatgcaca

SEQ ID NO: 50584 - DNA, 24 bp, Homo sapiens
ttggaagtaacaaagaatatgcac

SEQ ID NO: 50585 - DNA, 23 bp, Homo sapiens
cagttggctgctgaggctgcggc

SEQ ID NO: 50586 - DNA, 23 bp, Homo sapiens
gcagaacaaggacatgctccagc

SEQ ID NO: 50587 - DNA, 23 bp, Homo sapiens
gctggtcaagcaggtgcaagagc

SEQ ID NO: 50588 - DNA, 24 bp, Homo sapiens
tgatgaattagaggacgttttttt

SEQ ID NO: 50589 - DNA, 24 bp, Homo sapiens
ttgatgaattagaggacgtttttt

SEQ ID NO: 50590 - DNA, 24 bp, Homo sapiens
tttgatgaattagaggacgttttt

SEQ ID NO: 50591 - DNA, 25 bp, Homo sapiens
actgaagaacatctggcttatggca

SEQ ID NO: 50592 - DNA, 25 bp, Homo sapiens
aggtgaagacagatgacagagtggt

SEQ ID NO: 50593 - DNA, 25 bp, Homo sapiens
ccttggaggtagtggaagaggagaa

SEQ ID NO: 50594 - DNA, 24 bp, Homo sapiens
atactgagattgtatcctttatac

SEQ ID NO: 50595 - DNA, 24 bp, Homo sapiens
aatactgagattgtatcctttata

SEQ ID NO: 50596 - DNA, 24 bp, Homo sapiens
taatactgagattgtatcctttat

SEQ ID NO: 50597 - DNA, 23 bp, Homo sapiens
gggacctgaggctgtgtgtgtgt

SEQ ID NO: 50598 - DNA, 23 bp, Homo sapiens
gtgtgtgtgtgtgagtggagagt

SEQ ID NO: 50599 - DNA, 23 bp, Homo sapiens
tggccactggcggggtcgggggg

SEQ ID NO: 50600 - DNA, 24 bp, Homo sapiens
gagaaaccttggtaaaaaaaaaaa

SEQ ID NO: 50601 - DNA, 24 bp, Homo sapiens
ggagaaaccttggtaaaaaaaaaa

SEQ ID NO: 50602 - DNA, 24 bp, Homo sapiens
ggagaaaccttggtaaaaaaaaaa

SEQ ID NO: 50603 - DNA, 24 bp, Homo sapiens
atgaattcaaggtagaaatgagtc

SEQ ID NO: 50604 - DNA, 24 bp, Homo sapiens
aatgaattcaaggtagaaatgagt

SEQ ID NO: 50605 - DNA, 24 bp, Homo sapiens
gaatgaattcaaggtagaaatgag

SEQ ID NO: 50606 - DNA, 24 bp, Homo sapiens
tgtttttgaaggtttcaatgagag

SEQ ID NO: 50607 - DNA, 24 bp, Homo sapiens
ctgtttttgaaggtttcaatgaga

SEQ ID NO: 50608 - DNA, 24 bp, Homo sapiens
tctgtttttgaaggtttcaatgag

SEQ ID NO: 50609 - DNA, 24 bp, Homo sapiens
agtaatttctgactccagtaaaga

SEQ ID NO: 50610 - DNA, 24 bp, Homo sapiens
aagtaatttctgactccagtaaag

SEQ ID NO: 50611 - DNA, 24 bp, Homo sapiens
caagtaatttctgactccagtaaa

SEQ ID NO: 50612 - DNA, 24 bp, Homo sapiens
tcgaaaaactggtaagttggttta

SEQ ID NO: 50613 - DNA, 24 bp, Homo sapiens
ttcgaaaaactggtaagttggttt

SEQ ID NO: 50614 - DNA, 24 bp, Homo sapiens
cttcgaaaaactggtaagttggtt

SEQ ID NO: 50615 - DNA, 25 bp, Homo sapiens
ttggaagtcagtaaggatggtggct

SEQ ID NO: 50616 - DNA, 23 bp, Homo sapiens
gtgctctggctggtgctcagttg

SEQ ID NO: 50617 - DNA, 24 bp, Homo sapiens
cctaacagtggatgtggaacagcc

SEQ ID NO: 50618 - DNA, 24 bp, Homo sapiens
ctagcttacaggtaaacatattga

SEQ ID NO: 50619 - DNA, 24 bp, Homo sapiens
gctagcttacaggtaaacatattg

SEQ ID NO: 50620 - DNA, 24 bp, Homo sapiens
tgctagcttacaggtaaacatatt

SEQ ID NO: 50621 - DNA, 24 bp, Homo sapiens
gaatattgcaggtaattctttaaa

SEQ ID NO: 50622 - DNA, 24 bp, Homo sapiens
ggaatattgcaggtaattctttaa

SEQ ID NO: 50623 - DNA, 24 bp, Homo sapiens
tggaatattgcaggtaattcttta

SEQ ID NO: 50624 - DNA, 24 bp, Homo sapiens
ccttttcaaagaaaccatcagaat

SEQ ID NO: 50625 - DNA, 24 bp, Homo sapiens
accttttcaaagaaaccatcagaa

SEQ ID NO: 50626 - DNA, 24 bp, Homo sapiens
taccttttcaaagaaaccatcaga

SEQ ID NO: 50627 - DNA, 24 bp, Homo sapiens
ttttaatgcagcaattgagaatgt

SEQ ID NO: 50628 - DNA, 24 bp, Homo sapiens
tttttaatgcagcaattgagaatg

SEQ ID NO: 50629 - DNA, 24 bp, Homo sapiens
ttttttaatgcagcaattgagaat

SEQ ID NO: 50630 - DNA, 23 bp, Homo sapiens
gcgtggcagcgtgtgatacagat

SEQ ID NO: 50631 - DNA, 25 bp, Homo sapiens
ttcagcctcttgtcctttaagtcct

SEQ ID NO: 50632 - DNA, 25 bp, Homo sapiens
ctcgaatgtccagtctcaggtgatc

SEQ ID NO: 50633 - DNA, 24 bp, Homo sapiens
ttgtatccttggtaagtattatac

SEQ ID NO: 50634 - DNA, 24 bp, Homo sapiens
gttgtatccttggtaagtattata

SEQ ID NO: 50635 - DNA, 24 bp, Homo sapiens
tgttgtatccttggtaagtattat

SEQ ID NO: 50636 - DNA, 24 bp, Homo sapiens
ttgtgtctaatgtatttatgcaag

SEQ ID NO: 50637 - DNA, 24 bp, Homo sapiens
gttgtgtctaatgtatttatgcaa

SEQ ID NO: 50638 - DNA, 24 bp, Homo sapiens
agttgtgtctaatgtatttatgca

SEQ ID NO: 50639 - DNA, 24 bp, Homo sapiens
ttcagatagtgcttaacattgaga

SEQ ID NO: 50640 - DNA, 24 bp, Homo sapiens
tttcagatagtgcttaacattgag

SEQ ID NO: 50641 - DNA, 24 bp, Homo sapiens
atttcagatagtgcttaacattga

SEQ ID NO: 50642 - DNA, 23 bp, Homo sapiens
atgaccaccagatagaagccccg

SEQ ID NO: 50643 - DNA, 25 bp, Homo sapiens
gcagggtcaccctcatttatcagct

SEQ ID NO: 50644 - DNA, 23 bp, Homo sapiens
gggcagagggcaaggacaggtgg

SEQ ID NO: 50645 - DNA, 24 bp, Homo sapiens
gcgagtagccatgtggaggaaagt

SEQ ID NO: 50646 - DNA, 23 bp, Homo sapiens
cagacccctaccgagctccaagg

SEQ ID NO: 50647 - DNA, 23 bp, Homo sapiens
ctgccacctcccacagtctcctg

SEQ ID NO: 50648 - DNA, 24 bp, Homo sapiens
agacagagaagacgaggtggagcc

SEQ ID NO: 50649 - DNA, 23 bp, Homo sapiens
cctcagatggtgtccaggagacc

SEQ ID NO: 50650 - DNA, 24 bp, Homo sapiens
gaaagaaggaggttataaatgaag

SEQ ID NO: 50651 - DNA, 24 bp, Homo sapiens
cgaaagaaggaggttataaatgaa

SEQ ID NO: 50652 - DNA, 24 bp, Homo sapiens
ccgaaagaaggaggttataaatga

SEQ ID NO: 50653 - DNA, 24 bp, Homo sapiens
gctcctgctctacctccttctgct

SEQ ID NO: 50654 - DNA, 25 bp, Homo sapiens
tggaggaacaggcagaagataagaa

SEQ ID NO: 50655 - DNA, 25 bp, Homo sapiens
agtctgaagaaggtaatggctctgt

SEQ ID NO: 50656 - DNA, 24 bp, Homo sapiens
ctgtgatcatgatcttcgagatga

SEQ ID NO: 50657 - DNA, 24 bp, Homo sapiens
gctgtgatcatgatcttcgagatg

SEQ ID NO: 50658 - DNA, 24 bp, Homo sapiens
cgctgtgatcatgatcttcgagat

SEQ ID NO: 50659 - DNA, 25 bp, Homo sapiens
aggatgtgcttggctgactatgagg

SEQ ID NO: 50660 - DNA, 25 bp, Homo sapiens
cgtgtcaagagcctgaactgttgga

SEQ ID NO: 50661 - DNA, 25 bp, Homo sapiens
cacagtgtaggttcctatcctgctt

SEQ ID NO: 50662 - DNA, 24 bp, Homo sapiens
gttggttctcacgctgctgctgta

SEQ ID NO: 50663 - DNA, 23 bp, Homo sapiens
gtgctggtgtcgctggtggagag

SEQ ID NO: 50664 - DNA, 23 bp, Homo sapiens
tactcgcagcagaggaggcagag

SEQ ID NO: 50665 - DNA, 23 bp, Homo sapiens
tagtgaggtgtggctggacagtc

SEQ ID NO: 50666 - DNA, 23 bp, Homo sapiens
gcctcccactttgccctcatcac

SEQ ID NO: 50667 - DNA, 23 bp, Homo sapiens
cggagacatcaaggaacggctgg

SEQ ID NO: 50668 - DNA, 24 bp, Homo sapiens
atcccagcgaggtcgagcgccccg

SEQ ID NO: 50669 - DNA, 24 bp, Homo sapiens
gatcccagcgaggtcgagcgcccc

SEQ ID NO: 50670 - DNA, 24 bp, Homo sapiens
cgatcccagcgaggtcgagcgccc

SEQ ID NO: 50671 - DNA, 23 bp, Homo sapiens
gtagcagcagccaccccgagcac

SEQ ID NO: 50672 - DNA, 23 bp, Homo sapiens
cagagcatctggtcccgcctgca

SEQ ID NO: 50673 - DNA, 23 bp, Homo sapiens
gatgctgaagcaccagtgcacct

SEQ ID NO: 50674 - DNA, 25 bp, Homo sapiens
gcggtgtctatcaagtggcaagtct

SEQ ID NO: 50675 - DNA, 25 bp, Homo sapiens
tgacacggcttctaagacctccacc

SEQ ID NO: 50676 - DNA, 23 bp, Homo sapiens
atctcctgaccttgtgatccgcc

SEQ ID NO: 50677 - DNA, 24 bp, Homo sapiens
atccacttccgcaaggaccctttg

SEQ ID NO: 50678 - DNA, 23 bp, Homo sapiens
cgagagcgtcatttgggcggtca

SEQ ID NO: 50679 - DNA, 23 bp, Homo sapiens
ctgcgactgctgctgctgctgct

SEQ ID NO: 50680 - DNA, 25 bp, Homo sapiens
ttcttccacctctgccactaattcg

SEQ ID NO: 50681 - DNA, 24 bp, Homo sapiens
aaataaatatgcaggagggaaccc

SEQ ID NO: 50682 - DNA, 25 bp, Homo sapiens
ggttgtcccctaaagattctgaaaa

SEQ ID NO: 50683 - DNA, 25 bp, Homo sapiens
ggtgagttcaacgagaagaagacaa

SEQ ID NO: 50684 - DNA, 23 bp, Homo sapiens
aattgctgcttctggctggctgg

SEQ ID NO: 50685 - DNA, 25 bp, Homo sapiens
ctcaagagtgactacatcagcctgc

SEQ ID NO: 50686 - DNA, 24 bp, Homo sapiens
ttaattttcagatgtaacatttat

SEQ ID NO: 50687 - DNA, 24 bp, Homo sapiens
tttaattttcagatgtaacattta

SEQ ID NO: 50688 - DNA, 24 bp, Homo sapiens
ttttaattttcagatgtaacattt

SEQ ID NO: 50689 - DNA, 24 bp, Homo sapiens
tgtttttaaaggtaatcaaacatt

SEQ ID NO: 50690 - DNA, 24 bp, Homo sapiens
atgtttttaaaggtaatcaaacat

SEQ ID NO: 50691 - DNA, 24 bp, Homo sapiens
aatgtttttaaaggtaatcaaaca

SEQ ID NO: 50692 - DNA, 24 bp, Homo sapiens
ttcaaataaagaaaagcatgaact

SEQ ID NO: 50693 - DNA, 24 bp, Homo sapiens
tttcaaataaagaaaagcatgaac

SEQ ID NO: 50694 - DNA, 24 bp, Homo sapiens
ttttcaaataaagaaaagcatgaa

SEQ ID NO: 50695 - DNA, 24 bp, Homo sapiens
atgatcgcagacactgtccgaacc

SEQ ID NO: 50696 - DNA, 24 bp, Homo sapiens
cactgcctcacctcccctgtatct

SEQ ID NO: 50697 - DNA, 24 bp, Homo sapiens
tgagctacgggaatgtctatgcca

SEQ ID NO: 50698 - DNA, 24 bp, Homo sapiens
agcccagcaagacccagcctggga

SEQ ID NO: 50699 - DNA, 24 bp, Homo sapiens
gagcccagcaagacccagcctggg

SEQ ID NO: 50700 - DNA, 24 bp, Homo sapiens
agagcccagcaagacccagcctgg

SEQ ID NO: 50701 - DNA, 24 bp, Homo sapiens
gtgcctgtggtgctgctgggtcag

SEQ ID NO: 50702 - DNA, 24 bp, Homo sapiens
agtgcctgtggtgctgctgggtca

SEQ ID NO: 50703 - DNA, 24 bp, Homo sapiens
cagtgcctgtggtgctgctgggtc

SEQ ID NO: 50704 - DNA, 23 bp, Homo sapiens
caccacagtaaccgctgctcctg

SEQ ID NO: 50705 - DNA, 23 bp, Homo sapiens
gtgctgctgctgctgggctgctg

SEQ ID NO: 50706 - DNA, 23 bp, Homo sapiens
ggccgggggcctcactcatgcta

SEQ ID NO: 50707 - DNA, 25 bp, Homo sapiens
gcctcctgagtagctgggactacag

SEQ ID NO: 50708 - DNA, 24 bp, Homo sapiens
ctttatttcagtgatatcagtatc

SEQ ID NO: 50709 - DNA, 24 bp, Homo sapiens
tctttatttcagtgatatcagtat

SEQ ID NO: 50710 - DNA, 24 bp, Homo sapiens
ttctttatttcagtgatatcagta

SEQ ID NO: 50711 - DNA, 24 bp, Homo sapiens
ttaaagaaatagtaagtaaatagt

SEQ ID NO: 50712 - DNA, 24 bp, Homo sapiens
attaaagaaatagtaagtaaatag

SEQ ID NO: 50713 - DNA, 24 bp, Homo sapiens
cattaaagaaatagtaagtaaata

SEQ ID NO: 50714 - DNA, 24 bp, Homo sapiens
tctctattaaggtagttacttttg

SEQ ID NO: 50715 - DNA, 24 bp, Homo sapiens
ttctctattaaggtagttactttt

SEQ ID NO: 50716 - DNA, 24 bp, Homo sapiens
attctctattaaggtagttacttt

SEQ ID NO: 50717 - DNA, 23 bp, Homo sapiens
agtgctgctgctgctggtattcg

SEQ ID NO: 50718 - DNA, 24 bp, Homo sapiens
gatctgctcggctgcctcaagtac

SEQ ID NO: 50719 - DNA, 25 bp, Homo sapiens
tcttcttctacaaattcgggctgga

SEQ ID NO: 50720 - DNA, 24 bp, Homo sapiens
atcggacacaggttgtgggcattt

SEQ ID NO: 50721 - DNA, 24 bp, Homo sapiens
catcggacacaggttgtgggcatt

SEQ ID NO: 50722 - DNA, 24 bp, Homo sapiens
gcatcggacacaggttgtgggcat

SEQ ID NO: 50723 - DNA, 23 bp, Homo sapiens
gcactaggctcacggcaacctcc

SEQ ID NO: 50724 - DNA, 23 bp, Homo sapiens
cgtctgttcctccatttcccgcc

SEQ ID NO: 50725 - DNA, 25 bp, Homo sapiens
ggattaaagaacaacgaccgcaggc

SEQ ID NO: 50726 - DNA, 24 bp, Homo sapiens
acaggcccaagggtcgagaggagg

SEQ ID NO: 50727 - DNA, 24 bp, Homo sapiens
tacaggcccaagggtcgagaggag

SEQ ID NO: 50728 - DNA, 24 bp, Homo sapiens
ctacaggcccaagggtcgagagga

SEQ ID NO: 50729 - DNA, 25 bp, Homo sapiens
ctctcactgttgacggcatcatgtt

SEQ ID NO: 50730 - DNA, 25 bp, Homo sapiens
cccaggtcagtgtttcaggctctac

SEQ ID NO: 50731 - DNA, 23 bp, Homo sapiens
tggtgctgctgctcaagtccctc

SEQ ID NO: 50732 - DNA, 23 bp, Homo sapiens
tggtgctgctgctcaagtccctc

SEQ ID NO: 50733 - DNA, 23 bp, Homo sapiens
ctggacaacacaggtggtctgac

SEQ ID NO: 50734 - DNA, 25 bp, Homo sapiens
cctgtccaagatgctcatcgtgtcc

SEQ ID NO: 50735 - DNA, 25 bp, Homo sapiens
cccagattacatagtgtatcacgag

SEQ ID NO: 50736 - DNA, 23 bp, Homo sapiens
gcaccccaccagctccctttttg

SEQ ID NO: 50737 - DNA, 23 bp, Homo sapiens
aacatccgcacagggatgccctg

SEQ ID NO: 50738 - DNA, 24 bp, Homo sapiens
tgtcagaaagtgatttttctaaag

SEQ ID NO: 50739 - DNA, 24 bp, Homo sapiens
gtgtcagaaagtgatttttctaaa

SEQ ID NO: 50740 - DNA, 24 bp, Homo sapiens
ggtgtcagaaagtgatttttctaa

SEQ ID NO: 50741 - DNA, 24 bp, Homo sapiens
tttgataacaggtagtatttatga

SEQ ID NO: 50742 - DNA, 24 bp, Homo sapiens
ttttgataacaggtagtatttatg

SEQ ID NO: 50743 - DNA, 24 bp, Homo sapiens
tttttgataacaggtagtatttat

SEQ ID NO: 50744 - DNA, 24 bp, Homo sapiens
ttgtttttcagaactatttgataa

SEQ ID NO: 50745 - DNA, 24 bp, Homo sapiens
gttgtttttcagaactatttgata

SEQ ID NO: 50746 - DNA, 24 bp, Homo sapiens
tgttgtttttcagaactatttgat

SEQ ID NO: 50747 - DNA, 23 bp, Homo sapiens
atcctaccacctcagcctcccga

SEQ ID NO: 50748 - DNA, 23 bp, Homo sapiens
gggctggtcttgaagtcctgggt

SEQ ID NO: 50749 - DNA, 25 bp, Homo sapiens
ttggtgaaactcttgatggatactt

SEQ ID NO: 50750 - DNA, 24 bp, Homo sapiens
tgtctctctagccaacttctaaag

SEQ ID NO: 50751 - DNA, 24 bp, Homo sapiens
ttgtctctctagccaacttctaaa

SEQ ID NO: 50752 - DNA, 24 bp, Homo sapiens
tttgtctctctagccaacttctaa

SEQ ID NO: 50753 - DNA, 23 bp, Homo sapiens
cacaggcagcagcagcaacgatg

SEQ ID NO: 50754 - DNA, 23 bp, Homo sapiens
gagccacctggagccaagcctag

SEQ ID NO: 50755 - DNA, 25 bp, Homo sapiens
aagaacattccaagaggagatgcct

SEQ ID NO: 50756 - DNA, 24 bp, Homo sapiens
tgtcaagctatcctcctgcctcgg

SEQ ID NO: 50757 - DNA, 24 bp, Homo sapiens
gcgagacaatgaggagatacaagg

SEQ ID NO: 50758 - DNA, 24 bp, Homo sapiens
aacacgaggccgaattccaagcta

SEQ ID NO: 50759 - DNA, 23 bp, Homo sapiens
ctcactgccacctccgcctccta

SEQ ID NO: 50760 - DNA, 24 bp, Homo sapiens
gagatggagtcttgctctgtcgcc

SEQ ID NO: 50761 - DNA, 25 bp, Homo sapiens
tccctcagagtgaagcaaaggaagt

SEQ ID NO: 50762 - DNA, 24 bp, Homo sapiens
gcaaggttgagatttaagttctca

SEQ ID NO: 50763 - DNA, 24 bp, Homo sapiens
agcaaggttgagatttaagttctc

SEQ ID NO: 50764 - DNA, 24 bp, Homo sapiens
gagcaaggttgagatttaagttct

SEQ ID NO: 50765 - DNA, 23 bp, Homo sapiens
ctaagactacagcctggacgaca

SEQ ID NO: 50766 - DNA, 23 bp, Homo sapiens
gccattctcccacttcagcctcc

SEQ ID NO: 50767 - DNA, 23 bp, Homo sapiens
ttttacttgaatggagacataat

SEQ ID NO: 50768 - DNA, 23 bp, Homo sapiens
ccttctcaaccgcattgctgctg

SEQ ID NO: 50769 - DNA, 23 bp, Homo sapiens
agccatcgcacccagcaggaaag

SEQ ID NO: 50770 - DNA, 23 bp, Homo sapiens
cttctcggcctctgggagctctg

SEQ ID NO: 50771 - DNA, 23 bp, Homo sapiens
agccatcgcacccagcaggaaag

SEQ ID NO: 50772 - DNA, 23 bp, Homo sapiens
ccttctcaaccgcattgctgctg

SEQ ID NO: 50773 - DNA, 23 bp, Homo sapiens
cgctgtgccacgctctggaaaca

SEQ ID NO: 50774 - DNA, 25 bp, Homo sapiens
tgccattcagttgccaatctcaagc

SEQ ID NO: 50775 - DNA, 24 bp, Homo sapiens
cgtaactgtatcagagggtgaggt

SEQ ID NO: 50776 - DNA, 25 bp, Homo sapiens
aacataagccagttttaatctactt

SEQ ID NO: 50777 - DNA, 23 bp, Homo sapiens
aggtgctggtggtcaatggagga

SEQ ID NO: 50778 - DNA, 24 bp, Homo sapiens
cgtaactgtatcagagggtgaggt

SEQ ID NO: 50779 - DNA, 25 bp, Homo sapiens
tgccattcagttgccaatctcaagc

SEQ ID NO: 50780 - DNA, 24 bp, Homo sapiens
agccaagactcacccagggtaaaa

SEQ ID NO: 50781 - DNA, 24 bp, Homo sapiens
agacaggtgcaatggaaacagtcc

SEQ ID NO: 50782 - DNA, 24 bp, Homo sapiens
gtgtcacagcagcccacgccaaca

SEQ ID NO: 50783 - DNA, 24 bp, Homo sapiens
gaggaagctggcatccagcaaaag

SEQ ID NO: 50784 - DNA, 24 bp, Homo sapiens
agaggaagctggcatccagcaaaa

SEQ ID NO: 50785 - DNA, 24 bp, Homo sapiens
aagaggaagctggcatccagcaaa

SEQ ID NO: 50786 - DNA, 24 bp, Homo sapiens
gcctcctgcagttctcctgtgcgg

SEQ ID NO: 50787 - DNA, 24 bp, Homo sapiens
cgcctcctgcagttctcctgtgcg

SEQ ID NO: 50788 - DNA, 24 bp, Homo sapiens
gcgcctcctgcagttctcctgtgc

SEQ ID NO: 50789 - DNA, 24 bp, Homo sapiens
ccgagaccgctgactgtgaatgac

SEQ ID NO: 50790 - DNA, 23 bp, Homo sapiens
gcagcagagggaggaagcagaga

SEQ ID NO: 50791 - DNA, 23 bp, Homo sapiens
ccgagtgctcctccgttgagaga

SEQ ID NO: 50792 - DNA, 24 bp, Homo sapiens
tgaaaataaaggagtggttattat

SEQ ID NO: 50793 - DNA, 24 bp, Homo sapiens
ctgaaaataaaggagtggttatta

SEQ ID NO: 50794 - DNA, 24 bp, Homo sapiens
tctgaaaataaaggagtggttatt

SEQ ID NO: 50795 - DNA, 23 bp, Homo sapiens
gcagcagagggaggaagcagaga

SEQ ID NO: 50796 - DNA, 24 bp, Homo sapiens
aagtcagggttgcagaatcagccg

SEQ ID NO: 50797 - DNA, 24 bp, Homo sapiens
ccgagaccgctgactgtgaatgac

SEQ ID NO: 50798 - DNA, 25 bp, Homo sapiens
ttctcactcagcatcatttccttga

SEQ ID NO: 50799 - DNA, 25 bp, Homo sapiens
acgcatcaatagttcattcctggct

SEQ ID NO: 50800 - DNA, 23 bp, Homo sapiens
ggtggatcacaaggtcaggagtt

SEQ ID NO: 50801 - DNA, 24 bp, Homo sapiens
gagaagccaaggctcaagaacagc

SEQ ID NO: 50802 - DNA, 24 bp, Homo sapiens
cgagaagccaaggctcaagaacag

SEQ ID NO: 50803 - DNA, 24 bp, Homo sapiens
acgagaagccaaggctcaagaaca

SEQ ID NO: 50804 - DNA, 25 bp, Homo sapiens
aactgtggtcacgctattacactcc

SEQ ID NO: 50805 - DNA, 24 bp, Homo sapiens
gcacacacctgtagtcccagcaac

SEQ ID NO: 50806 - DNA, 25 bp, Homo sapiens
gctgaagtgagaggattgcatggct

SEQ ID NO: 50807 - DNA, 24 bp, Homo sapiens
gactgaaaaagcagtgccccccag

SEQ ID NO: 50808 - DNA, 24 bp, Homo sapiens
agactgaaaaagcagtgcccccca

SEQ ID NO: 50809 - DNA, 24 bp, Homo sapiens
gagactgaaaaagcagtgcccccc

SEQ ID NO: 50810 - DNA, 24 bp, Homo sapiens
tggaacagagggaatttccatttt

SEQ ID NO: 50811 - DNA, 24 bp, Homo sapiens
ttggaacagagggaatttccattt

SEQ ID NO: 50812 - DNA, 24 bp, Homo sapiens
gttggaacagagggaatttccatt

SEQ ID NO: 50813 - DNA, 24 bp, Homo sapiens
attacttcttggtgagttattgtg

SEQ ID NO: 50814 - DNA, 24 bp, Homo sapiens
tattacttcttggtgagttattgt

SEQ ID NO: 50815 - DNA, 24 bp, Homo sapiens
ctattacttcttggtgagttattg

SEQ ID NO: 50816 - DNA, 24 bp, Homo sapiens
aatattttcagatagactagaaga

SEQ ID NO: 50817 - DNA, 24 bp, Homo sapiens
taatattttcagatagactagaag

SEQ ID NO: 50818 - DNA, 24 bp, Homo sapiens
ttaatattttcagatagactagaa

SEQ ID NO: 50819 - DNA, 23 bp, Homo sapiens
cgcttcaacgccttcatcctcgg

SEQ ID NO: 50820 - DNA, 24 bp, Homo sapiens
aaccacgaagacatcatccagacc

SEQ ID NO: 50821 - DNA, 23 bp, Homo sapiens
cagcagcggcagcacaaggaact

SEQ ID NO: 50822 - DNA, 23 bp, Homo sapiens
cagcagcggcagcacaaggaact

SEQ ID NO: 50823 - DNA, 23 bp, Homo sapiens
ctgctgctgtctgcccactccac

SEQ ID NO: 50824 - DNA, 24 bp, Homo sapiens
ggtgcctcagaaggtggagaagag

SEQ ID NO: 50825 - DNA, 24 bp, Homo sapiens
tagcagcagcccaggggacagcca

SEQ ID NO: 50826 - DNA, 24 bp, Homo sapiens
atagcagcagcccaggggacagcc

SEQ ID NO: 50827 - DNA, 24 bp, Homo sapiens
catagcagcagcccaggggacagc

SEQ ID NO: 50828 - DNA, 24 bp, Homo sapiens
tctccctgcagcactcggctggag

SEQ ID NO: 50829 - DNA, 24 bp, Homo sapiens
ttctccctgcagcactcggctgga

SEQ ID NO: 50830 - DNA, 24 bp, Homo sapiens
cttctccctgcagcactcggctgg

SEQ ID NO: 50831 - DNA, 25 bp, Homo sapiens
catagagaacctcattgctcctggc

SEQ ID NO: 50832 - DNA, 25 bp, Homo sapiens
tgaccaccacactacagcacattct

SEQ ID NO: 50833 - DNA, 23 bp, Homo sapiens
gactacgctgactgccatgacgc

SEQ ID NO: 50834 - DNA, 25 bp, Homo sapiens
ttccacactgtttcaccatctacgc

SEQ ID NO: 50835 - DNA, 25 bp, Homo sapiens
agagaagtggatgctggacctgaac

SEQ ID NO: 50836 - DNA, 25 bp, Homo sapiens
acgaggtatctctggagcaggagtc

SEQ ID NO: 50837 - DNA, 25 bp, Homo sapiens
tggatggttcaaggtctactgatga

SEQ ID NO: 50838 - DNA, 23 bp, Homo sapiens
ccacttgcgagtcaccgacagtc

SEQ ID NO: 50839 - DNA, 23 bp, Homo sapiens
ctcggacacagacactgccactg

SEQ ID NO: 50840 - DNA, 24 bp, Homo sapiens
ctttatttcagagatttgaacaat

SEQ ID NO: 50841 - DNA, 24 bp, Homo sapiens
tctttatttcagagatttgaacaa

SEQ ID NO: 50842 - DNA, 24 bp, Homo sapiens
ctctttatttcagagatttgaaca

SEQ ID NO: 50843 - DNA, 24 bp, Homo sapiens
ttttgttaaagggaacttaaaaga

SEQ ID NO: 50844 - DNA, 24 bp, Homo sapiens
tttttgttaaagggaacttaaaag

SEQ ID NO: 50845 - DNA, 24 bp, Homo sapiens
atttttgttaaagggaacttaaaa

SEQ ID NO: 50846 - DNA, 24 bp, Homo sapiens
caaccccaaaggattttgattatt

SEQ ID NO: 50847 - DNA, 24 bp, Homo sapiens
ccaaccccaaaggattttgattat

SEQ ID NO: 50848 - DNA, 24 bp, Homo sapiens
cccaaccccaaaggattttgatta

SEQ ID NO: 50849 - DNA, 25 bp, Homo sapiens
cctcgctccattctctccatcacat

SEQ ID NO: 50850 - DNA, 23 bp, Homo sapiens
gttctcccgctgccgccgcccca

SEQ ID NO: 50851 - DNA, 23 bp, Homo sapiens
ccggaagtaggcgtctccctgga

SEQ ID NO: 50852 - DNA, 25 bp, Homo sapiens
ttcttcacattcaccagacaccaga

SEQ ID NO: 50853 - DNA, 23 bp, Homo sapiens
caatgagccgtgatggtgccact

SEQ ID NO: 50854 - DNA, 23 bp, Homo sapiens
atgttcctagccaggtgcggagg

SEQ ID NO: 50855 - DNA, 24 bp, Homo sapiens
gtgaaagaaaattctggatactta

SEQ ID NO: 50856 - DNA, 24 bp, Homo sapiens
agtgaaagaaaattctggatactt

SEQ ID NO: 50857 - DNA, 24 bp, Homo sapiens
aagtgaaagaaaattctggatact

SEQ ID NO: 50858 - DNA, 24 bp, Homo sapiens
ctaatgtgaaggtacattaaaaaa

SEQ ID NO: 50859 - DNA, 24 bp, Homo sapiens
gctaatgtgaaggtacattaaaaa

SEQ ID NO: 50860 - DNA, 24 bp, Homo sapiens
agctaatgtgaaggtacattaaaa

SEQ ID NO: 50861 - DNA, 24 bp, Homo sapiens
tatttatgcaggcaaaatcctgac

SEQ ID NO: 50862 - DNA, 24 bp, Homo sapiens
gtatttatgcaggcaaaatcctga

SEQ ID NO: 50863 - DNA, 24 bp, Homo sapiens
tgtatttatgcaggcaaaatcctg

SEQ ID NO: 50864 - DNA, 24 bp, Homo sapiens
aagatgtcagtgtaagtgcctttt

SEQ ID NO: 50865 - DNA, 24 bp, Homo sapiens
caagatgtcagtgtaagtgccttt

SEQ ID NO: 50866 - DNA, 24 bp, Homo sapiens
acaagatgtcagtgtaagtgcctt

SEQ ID NO: 50867 - DNA, 24 bp, Homo sapiens
tatgatagcagatcttttggttga

SEQ ID NO: 50868 - DNA, 24 bp, Homo sapiens
atatgatagcagatcttttggttg

SEQ ID NO: 50869 - DNA, 24 bp, Homo sapiens
aatatgatagcagatcttttggtt

SEQ ID NO: 50870 - DNA, 24 bp, Homo sapiens
cgtggaacatgtgtgcatttttaa

SEQ ID NO: 50871 - DNA, 24 bp, Homo sapiens
ccgtggaacatgtgtgcattttta

SEQ ID NO: 50872 - DNA, 24 bp, Homo sapiens
gccgtggaacatgtgtgcattttt

SEQ ID NO: 50873 - DNA, 24 bp, Homo sapiens
cacgatagcaggtaacctaattcc

SEQ ID NO: 50874 - DNA, 24 bp, Homo sapiens
acacgatagcaggtaacctaattc

SEQ ID NO: 50875 - DNA, 24 bp, Homo sapiens
aacacgatagcaggtaacctaatt

SEQ ID NO: 50876 - DNA, 24 bp, Homo sapiens
ttaattcttagggtacatttaaat

SEQ ID NO: 50877 - DNA, 24 bp, Homo sapiens
attaattcttagggtacatttaaa

SEQ ID NO: 50878 - DNA, 24 bp, Homo sapiens
aattaattcttagggtacatttaa

SEQ ID NO: 50879 - DNA, 24 bp, Homo sapiens
ttacgttattggtgggatcacagt

SEQ ID NO: 50880 - DNA, 24 bp, Homo sapiens
tttacgttattggtgggatcacag

SEQ ID NO: 50881 - DNA, 24 bp, Homo sapiens
ttttacgttattggtgggatcaca

SEQ ID NO: 50882 - DNA, 24 bp, Homo sapiens
cttcaaatgaggtaagaatgatat

SEQ ID NO: 50883 - DNA, 24 bp, Homo sapiens
ccttcaaatgaggtaagaatgata

SEQ ID NO: 50884 - DNA, 24 bp, Homo sapiens
tccttcaaatgaggtaagaatgat

SEQ ID NO: 50885 - DNA, 24 bp, Homo sapiens
acacagatatgctcacaattgtaa

SEQ ID NO: 50886 - DNA, 24 bp, Homo sapiens
aacacagatatgctcacaattgta

SEQ ID NO: 50887 - DNA, 24 bp, Homo sapiens
caacacagatatgctcacaattgt

SEQ ID NO: 50888 - DNA, 25 bp, Homo sapiens
gctataatgctgctctgccttctac

SEQ ID NO: 50889 - DNA, 25 bp, Homo sapiens
aaacactccctgatgacgatgatgg

SEQ ID NO: 50890 - DNA, 25 bp, Homo sapiens
gtctttagccgtagccattagtagt

SEQ ID NO: 50891 - DNA, 24 bp, Homo sapiens
ttgaaccccaggtaatcattaaat

SEQ ID NO: 50892 - DNA, 24 bp, Homo sapiens
tttgaaccccaggtaatcattaaa

SEQ ID NO: 50893 - DNA, 24 bp, Homo sapiens
ttttgaaccccaggtaatcattaa

SEQ ID NO: 50894 - DNA, 24 bp, Homo sapiens
tcttttattaggcctgggtctctg

SEQ ID NO: 50895 - DNA, 24 bp, Homo sapiens
ctcttttattaggcctgggtctct

SEQ ID NO: 50896 - DNA, 24 bp, Homo sapiens
tctcttttattaggcctgggtctc

SEQ ID NO: 50897 - DNA, 23 bp, Homo sapiens
ctggcagggcaaggtggctcagg

SEQ ID NO: 50898 - DNA, 25 bp, Homo sapiens
tggtagatttatcagtaatgaggtt

SEQ ID NO: 50899 - DNA, 24 bp, Homo sapiens
atctcagcactttgagaggccgac

SEQ ID NO: 50900 - DNA, 24 bp, Homo sapiens
ttacataagttgtaagtgaaatag

SEQ ID NO: 50901 - DNA, 24 bp, Homo sapiens
tttacataagttgtaagtgaaata

SEQ ID NO: 50902 - DNA, 24 bp, Homo sapiens
ttttacataagttgtaagtgaaat

SEQ ID NO: 50903 - DNA, 24 bp, Homo sapiens
ttaaaatatctagacatgggaaca

SEQ ID NO: 50904 - DNA, 24 bp, Homo sapiens
attaaaatatctagacatgggaac

SEQ ID NO: 50905 - DNA, 24 bp, Homo sapiens
cattaaaatatctagacatgggaa

SEQ ID NO: 50906 - DNA, 24 bp, Homo sapiens
ttattttacaggccacaattgatt

SEQ ID NO: 50907 - DNA, 24 bp, Homo sapiens
tttattttacaggccacaattgat

SEQ ID NO: 50908 - DNA, 24 bp, Homo sapiens
ctttattttacaggccacaattga

SEQ ID NO: 50909 - DNA, 23 bp, Homo sapiens
gggagggctgcgggtggaaaggg

SEQ ID NO: 50910 - DNA, 23 bp, Homo sapiens
tttgtgcaaagttgggcggcggg

SEQ ID NO: 50911 - DNA, 23 bp, Homo sapiens
cgtggctgctgctgagtggcggg

SEQ ID NO: 50912 - DNA, 25 bp, Homo sapiens
actatcaaatgtgtggtcgtgggtg

SEQ ID NO: 50913 - DNA, 25 bp, Homo sapiens
aacaccacactcacgcagtatcagc

SEQ ID NO: 50914 - DNA, 23 bp, Homo sapiens
aggaggtcttggagcgttctcgg

SEQ ID NO: 50915 - DNA, 24 bp, Homo sapiens
aagtattagtggaacttggatttt

SEQ ID NO: 50916 - DNA, 24 bp, Homo sapiens
caagtattagtggaacttggattt

SEQ ID NO: 50917 - DNA, 24 bp, Homo sapiens
tcaagtattagtggaacttggatt

SEQ ID NO: 50918 - DNA, 23 bp, Homo sapiens
ttcggcaaatcagcagcggagag

SEQ ID NO: 50919 - DNA, 25 bp, Homo sapiens
catacggtggatgctgatggtgaac

SEQ ID NO: 50920 - DNA, 25 bp, Homo sapiens
gccactattgaggacattgccaacc

SEQ ID NO: 50921 - DNA, 24 bp, Homo sapiens
tatctttggtgatttatttgagtc

SEQ ID NO: 50922 - DNA, 24 bp, Homo sapiens
atatctttggtgatttatttgagt

SEQ ID NO: 50923 - DNA, 24 bp, Homo sapiens
gatatctttggtgatttatttgag

SEQ ID NO: 50924 - DNA, 23 bp, Homo sapiens
cagcaccagcaccaccaccacct

SEQ ID NO: 50925 - DNA, 25 bp, Homo sapiens
tgtcccagtcagcacttctaaacca

SEQ ID NO: 50926 - DNA, 25 bp, Homo sapiens
gtcttctccagccacaactgttacg

SEQ ID NO: 50927 - DNA, 23 bp, Homo sapiens
cagcaccagcaccaccaccacct

SEQ ID NO: 50928 - DNA, 25 bp, Homo sapiens
actttcctctgttccctctgaagca

SEQ ID NO: 50929 - DNA, 25 bp, Homo sapiens
gcttctgcctccactactacaactg

SEQ ID NO: 50930 - DNA, 23 bp, Homo sapiens
ctggtggtgaagaacaagaaggc

SEQ ID NO: 50931 - DNA, 24 bp, Homo sapiens
ctgaaggagctgttggagacgtgg

SEQ ID NO: 50932 - DNA, 23 bp, Homo sapiens
gtgaagtgccgcctggacagtag

SEQ ID NO: 50933 - DNA, 24 bp, Homo sapiens
aatgattgagccacctgtccagcc

SEQ ID NO: 50934 - DNA, 23 bp, Homo sapiens
cttggtcagcgtccattccagcc

SEQ ID NO: 50935 - DNA, 23 bp, Homo sapiens
ggatcaccgaggagatgcctgtg

SEQ ID NO: 50936 - DNA, 24 bp, Homo sapiens
atctctcttagttatctgtgctgt

SEQ ID NO: 50937 - DNA, 24 bp, Homo sapiens
tatctctcttagttatctgtgctg

SEQ ID NO: 50938 - DNA, 24 bp, Homo sapiens
gtatctctcttagttatctgtgct

SEQ ID NO: 50939 - DNA, 24 bp, Homo sapiens
atcacagtatgatttgaagaaccc

SEQ ID NO: 50940 - DNA, 24 bp, Homo sapiens
catcacagtatgatttgaagaacc

SEQ ID NO: 50941 - DNA, 24 bp, Homo sapiens
tcatcacagtatgatttgaagaac

SEQ ID NO: 50942 - DNA, 25 bp, Homo sapiens
ggaacctagaccaggtctccagagg

SEQ ID NO: 50943 - DNA, 23 bp, Homo sapiens
agtcgccgctgccgcctccgccc

SEQ ID NO: 50944 - DNA, 23 bp, Homo sapiens
cccgtcctcgcccgggactcctt

SEQ ID NO: 50945 - DNA, 23 bp, Homo sapiens
cagtcgccgctgccgcctccgcc

SEQ ID NO: 50946 - DNA, 23 bp, Homo sapiens
cgtcctcgcccgggactccttac

SEQ ID NO: 50947 - DNA, 24 bp, Homo sapiens
ggcaccaccaggcccccctgtctt

SEQ ID NO: 50948 - DNA, 24 bp, Homo sapiens
cggcaccaccaggcccccctgtct

SEQ ID NO: 50949 - DNA, 24 bp, Homo sapiens
gcggcaccaccaggcccccctgtc

SEQ ID NO: 50950 - DNA, 24 bp, Homo sapiens
agaatgaggaggttaggaaaaccc

SEQ ID NO: 50951 - DNA, 24 bp, Homo sapiens
gagaatgaggaggttaggaaaacc

SEQ ID NO: 50952 - DNA, 24 bp, Homo sapiens
agagaatgaggaggttaggaaaac

SEQ ID NO: 50953 - DNA, 24 bp, Homo sapiens
aagaggagagccaaccagcaggaa

SEQ ID NO: 50954 - DNA, 25 bp, Homo sapiens
gtctccgatgccttccaacacagtc

SEQ ID NO: 50955 - DNA, 25 bp, Homo sapiens
caagatagagaatgaggaggttagg

SEQ ID NO: 50956 - DNA, 23 bp, Homo sapiens
tgacagcccacacagcgagccag

SEQ ID NO: 50957 - DNA, 25 bp, Homo sapiens
agtatagcgacgagaacatgatgga

SEQ ID NO: 50958 - DNA, 24 bp, Homo sapiens
acctcttcgctttcctcaaccacc

SEQ ID NO: 50959 - DNA, 25 bp, Homo sapiens
ccaacttccttatgacgatgctgtt

SEQ ID NO: 50960 - DNA, 24 bp, Homo sapiens
atgtggcggtttcgtttgctgaga

SEQ ID NO: 50961 - DNA, 23 bp, Homo sapiens
cgtggtgctgctgcttctgacag

SEQ ID NO: 50962 - DNA, 25 bp, Homo sapiens
ttggtgattctgagcctgaacttga

SEQ ID NO: 50963 - DNA, 25 bp, Homo sapiens
agacaaccatctcctgaacctgtgc

SEQ ID NO: 50964 - DNA, 25 bp, Homo sapiens
tgaacctgaacctgagccagaatct

SEQ ID NO: 50965 - DNA, 24 bp, Homo sapiens
tactggatatggtaatgataatct

SEQ ID NO: 50966 - DNA, 24 bp, Homo sapiens
ttactggatatggtaatgataatc

SEQ ID NO: 50967 - DNA, 24 bp, Homo sapiens
tttactggatatggtaatgataat

SEQ ID NO: 50968 - DNA, 23 bp, Homo sapiens
ccagcagcatcagcagcagcagg

SEQ ID NO: 50969 - DNA, 23 bp, Homo sapiens
gtctcgggaaagggagcaccaga

SEQ ID NO: 50970 - DNA, 23 bp, Homo sapiens
ccacggtctgaagcacctgttcc

SEQ ID NO: 50971 - DNA, 23 bp, Homo sapiens
gcaacgtgtacctcctggctgag

SEQ ID NO: 50972 - DNA, 23 bp, Homo sapiens
gctcttcctccaccaccgacact

SEQ ID NO: 50973 - DNA, 23 bp, Homo sapiens
ccagcagcatcagcagcagcagg

SEQ ID NO: 50974 - DNA, 25 bp, Homo sapiens
agaacgagatgacgaacctgaagca

SEQ ID NO: 50975 - DNA, 24 bp, Homo sapiens
ctatgagagggcacgggacatcca

SEQ ID NO: 50976 - DNA, 23 bp, Homo sapiens
agcagcaacagcagcaggtggta

SEQ ID NO: 50977 - DNA, 23 bp, Homo sapiens
tgtcctcaccaaggagtatgagg

SEQ ID NO: 50978 - DNA, 23 bp, Homo sapiens
ctgctgctgctgggctctgccct

SEQ ID NO: 50979 - DNA, 24 bp, Homo sapiens
tcacagagcaggaactgaagcatc

SEQ ID NO: 50980 - DNA, 24 bp, Homo sapiens
ctcacagagcaggaactgaagcat

SEQ ID NO: 50981 - DNA, 24 bp, Homo sapiens
cctcacagagcaggaactgaagca

SEQ ID NO: 50982 - DNA, 24 bp, Homo sapiens
tggatggagaaaattacatgatgc

SEQ ID NO: 50983 - DNA, 24 bp, Homo sapiens
ctggatggagaaaattacatgatg

SEQ ID NO: 50984 - DNA, 24 bp, Homo sapiens
cctggatggagaaaattacatgat

SEQ ID NO: 50985 - DNA, 23 bp, Homo sapiens
cgtccgccgcttctcttcctagt

SEQ ID NO: 50986 - DNA, 23 bp, Homo sapiens
gacaccgagacagccagccctct

SEQ ID NO: 50987 - DNA, 23 bp, Homo sapiens
gggcgagtatccgttgctgtgtc

SEQ ID NO: 50988 - DNA, 23 bp, Homo sapiens
gacaccgagacagccagccctct

SEQ ID NO: 50989 - DNA, 24 bp, Homo sapiens
gtatccgttgctgtgtcggagaca

SEQ ID NO: 50990 - DNA, 23 bp, Homo sapiens
ggagcaggtcggcctcggcccag

SEQ ID NO: 50991 - DNA, 24 bp, Homo sapiens
ctgtgaaagagattctgagcattc

SEQ ID NO: 50992 - DNA, 24 bp, Homo sapiens
actgtgaaagagattctgagcatt

SEQ ID NO: 50993 - DNA, 24 bp, Homo sapiens
gactgtgaaagagattctgagcat

SEQ ID NO: 50994 - DNA, 24 bp, Homo sapiens
gtactttctggacctgaagattca

SEQ ID NO: 50995 - DNA, 24 bp, Homo sapiens
ggtactttctggacctgaagattc

SEQ ID NO: 50996 - DNA, 24 bp, Homo sapiens
tggtactttctggacctgaagatt

SEQ ID NO: 50997 - DNA, 24 bp, Homo sapiens
tcaacctgatgaacccatgacagt

SEQ ID NO: 50998 - DNA, 24 bp, Homo sapiens
atcaacctgatgaacccatgacag

SEQ ID NO: 50999 - DNA, 24 bp, Homo sapiens
catcaacctgatgaacccatgaca

SEQ ID NO: 51000 - DNA, 24 bp, Homo sapiens
ttataagacagggaagatcttatc

SEQ ID NO: 51001 - DNA, 24 bp, Homo sapiens
tttataagacagggaagatcttat

SEQ ID NO: 51002 - DNA, 24 bp, Homo sapiens
ctttataagacagggaagatctta

SEQ ID NO: 51003 - DNA, 23 bp, Homo sapiens
tcacgcctgtaattccagcactt

SEQ ID NO: 51004 - DNA, 23 bp, Homo sapiens
aaaaaacctttatggccgggcac

SEQ ID NO: 51005 - DNA, 24 bp, Homo sapiens
aatgcacacagtaagaaagataca

SEQ ID NO: 51006 - DNA, 24 bp, Homo sapiens
aaatgcacacagtaagaaagatac

SEQ ID NO: 51007 - DNA, 24 bp, Homo sapiens
gaaatgcacacagtaagaaagata

SEQ ID NO: 51008 - DNA, 24 bp, Homo sapiens
gatatctgaaggggtatactctag

SEQ ID NO: 51009 - DNA, 24 bp, Homo sapiens
ggatatctgaaggggtatactcta

SEQ ID NO: 51010 - DNA, 24 bp, Homo sapiens
aggatatctgaaggggtatactct

SEQ ID NO: 51011 - DNA, 23 bp, Homo sapiens
cctgctggacctgcccgtgctgc

SEQ ID NO: 51012 - DNA, 25 bp, Homo sapiens
tgctcaaaaagaataagaaccaggg

SEQ ID NO: 51013 - DNA, 25 bp, Homo sapiens
aattaaggtaaaaataacgcacttt

SEQ ID NO: 51014 - DNA, 24 bp, Homo sapiens
gagatgcacagccgcagccgcctg

SEQ ID NO: 51015 - DNA, 24 bp, Homo sapiens
agagatgcacagccgcagccgcct

SEQ ID NO: 51016 - DNA, 24 bp, Homo sapiens
gagagatgcacagccgcagccgcc

SEQ ID NO: 51017 - DNA, 23 bp, Homo sapiens
acgcttccagtctatgccggtga

SEQ ID NO: 51018 - DNA, 24 bp, Homo sapiens
cgtgcttcggaacatcaccaactc

SEQ ID NO: 51019 - DNA, 23 bp, Homo sapiens
gaagagcgaggcgggcagtggag

SEQ ID NO: 51020 - DNA, 25 bp, Homo sapiens
gtgaccttgattgagttaatgaact

SEQ ID NO: 51021 - DNA, 23 bp, Homo sapiens
gaatcctggcccaccgcctgccc

SEQ ID NO: 51022 - DNA, 23 bp, Homo sapiens
ctcagcgcagccagtcgcggagg

SEQ ID NO: 51023 - DNA, 23 bp, Homo sapiens
aacaccaccacgaccagccgcta

SEQ ID NO: 51024 - DNA, 24 bp, Homo sapiens
ccttccacgccatacttcgctctg

SEQ ID NO: 51025 - DNA, 24 bp, Homo sapiens
ggtggaatggtggctcctggaatg

SEQ ID NO: 51026 - DNA, 25 bp, Homo sapiens
atgtggaactacactggaggacacc

SEQ ID NO: 51027 - DNA, 23 bp, Homo sapiens
gagctggtctcggcaagtggtgc

SEQ ID NO: 51028 - DNA, 23 bp, Homo sapiens
cgaacctgggtcgaatagtcgcc

SEQ ID NO: 51029 - DNA, 24 bp, Homo sapiens
gagcaaaaaaggtaaatcagaatt

SEQ ID NO: 51030 - DNA, 24 bp, Homo sapiens
agagcaaaaaaggtaaatcagaat

SEQ ID NO: 51031 - DNA, 24 bp, Homo sapiens
aagagcaaaaaaggtaaatcagaa

SEQ ID NO: 51032 - DNA, 24 bp, Homo sapiens
tttagtaatagtggcagctaattt

SEQ ID NO: 51033 - DNA, 24 bp, Homo sapiens
atttagtaatagtggcagctaatt

SEQ ID NO: 51034 - DNA, 24 bp, Homo sapiens
gatttagtaatagtggcagctaat

SEQ ID NO: 51035 - DNA, 23 bp, Homo sapiens
aacgcaccgccacctacctaccg

SEQ ID NO: 51036 - DNA, 23 bp, Homo sapiens
agaatagaattcatcaatgaaaa

SEQ ID NO: 51037 - DNA, 25 bp, Homo sapiens
ccatcggagattactacgcctgtgc

SEQ ID NO: 51038 - DNA, 24 bp, Homo sapiens
ccgtggtgacatcatggctattgc

SEQ ID NO: 51039 - DNA, 24 bp, Homo sapiens
gtgtggctgctctgctatgtcctg

SEQ ID NO: 51040 - DNA, 23 bp, Homo sapiens
tgcattccagtggcaatcggcgt

SEQ ID NO: 51041 - DNA, 25 bp, Homo sapiens
ttgtctcctacgggaatattagagt

SEQ ID NO: 51042 - DNA, 23 bp, Homo sapiens
tttttcttgggctggagctgagg

SEQ ID NO: 51043 - DNA, 24 bp, Homo sapiens
cccagccccagttccagcgccagg

SEQ ID NO: 51044 - DNA, 24 bp, Homo sapiens
tcccagccccagttccagcgccag

SEQ ID NO: 51045 - DNA, 24 bp, Homo sapiens
gtcccagccccagttccagcgcca

SEQ ID NO: 51046 - DNA, 24 bp, Homo sapiens
cgtccgttcaacagccatcctacc

SEQ ID NO: 51047 - DNA, 24 bp, Homo sapiens
cagcaacagcagcaacagcaacag

SEQ ID NO: 51048 - DNA, 23 bp, Homo sapiens
cagcagcagcagcagcagcagta

SEQ ID NO: 51049 - DNA, 24 bp, Homo sapiens
ataaataaaagtgaacacttgtcc

SEQ ID NO: 51050 - DNA, 24 bp, Homo sapiens
tataaataaaagtgaacacttgtc

SEQ ID NO: 51051 - DNA, 24 bp, Homo sapiens
ctataaataaaagtgaacacttgt

SEQ ID NO: 51052 - DNA, 23 bp, Homo sapiens
tgcccgtcctccatcaacaagtt

SEQ ID NO: 51053 - DNA, 24 bp, Homo sapiens
atgactcagacctggctgtctctt

SEQ ID NO: 51054 - DNA, 23 bp, Homo sapiens
accttgataatctcttcaattct

SEQ ID NO: 51055 - DNA, 24 bp, Homo sapiens
taacaaacaaggtacaaaaccatt

SEQ ID NO: 51056 - DNA, 24 bp, Homo sapiens
ttaacaaacaaggtacaaaaccat

SEQ ID NO: 51057 - DNA, 24 bp, Homo sapiens
attaacaaacaaggtacaaaacca

SEQ ID NO: 51058 - DNA, 24 bp, Homo sapiens
atgtatactaggtttgtccaatga

SEQ ID NO: 51059 - DNA, 24 bp, Homo sapiens
tatgtatactaggtttgtccaatg

SEQ ID NO: 51060 - DNA, 24 bp, Homo sapiens
ttatgtatactaggtttgtccaat

SEQ ID NO: 51061 - DNA, 24 bp, Homo sapiens
tagaagaaatggtaagtaatttaa

SEQ ID NO: 51062 - DNA, 24 bp, Homo sapiens
atagaagaaatggtaagtaattta

SEQ ID NO: 51063 - DNA, 24 bp, Homo sapiens
catagaagaaatggtaagtaattt

SEQ ID NO: 51064 - DNA, 24 bp, Homo sapiens
tatggatctttgtaagtaattgga

SEQ ID NO: 51065 - DNA, 24 bp, Homo sapiens
ttatggatctttgtaagtaattgg

SEQ ID NO: 51066 - DNA, 24 bp, Homo sapiens
attatggatctttgtaagtaattg

SEQ ID NO: 51067 - DNA, 24 bp, Homo sapiens
ggatttaatgaacatgcagagcag

SEQ ID NO: 51068 - DNA, 24 bp, Homo sapiens
aggatttaatgaacatgcagagca

SEQ ID NO: 51069 - DNA, 24 bp, Homo sapiens
aaggatttaatgaacatgcagagc

SEQ ID NO: 51070 - DNA, 24 bp, Homo sapiens
ttatttcaaatgaaatcagtagct

SEQ ID NO: 51071 - DNA, 24 bp, Homo sapiens
attatttcaaatgaaatcagtagc

SEQ ID NO: 51072 - DNA, 24 bp, Homo sapiens
cattatttcaaatgaaatcagtag

SEQ ID NO: 51073 - DNA, 24 bp, Homo sapiens
agatggtagagcatatattaaaca

SEQ ID NO: 51074 - DNA, 24 bp, Homo sapiens
aagatggtagagcatatattaaac

SEQ ID NO: 51075 - DNA, 24 bp, Homo sapiens
aaagatggtagagcatatattaaa

SEQ ID NO: 51076 - DNA, 24 bp, Homo sapiens
gtttttaatagtgaaaatgaaaaa

SEQ ID NO: 51077 - DNA, 24 bp, Homo sapiens
tgtttttaatagtgaaaatgaaaa

SEQ ID NO: 51078 - DNA, 24 bp, Homo sapiens
ttgtttttaatagtgaaaatgaaa

SEQ ID NO: 51079 - DNA, 25 bp, Homo sapiens
actgttctgggacaaggagactcag

SEQ ID NO: 51080 - DNA, 24 bp, Homo sapiens
cggagaaattccaggaacaactgc

SEQ ID NO: 51081 - DNA, 23 bp, Homo sapiens
acctcctcgccgccgccgtcgtc

SEQ ID NO: 51082 - DNA, 24 bp, Homo sapiens
atatttaacagacaaatggtggcc

SEQ ID NO: 51083 - DNA, 24 bp, Homo sapiens
catatttaacagacaaatggtggc

SEQ ID NO: 51084 - DNA, 24 bp, Homo sapiens
acatatttaacagacaaatggtgg

SEQ ID NO: 51085 - DNA, 24 bp, Homo sapiens
attctttccatgtaagagccagtg

SEQ ID NO: 51086 - DNA, 24 bp, Homo sapiens
aattctttccatgtaagagccagt

SEQ ID NO: 51087 - DNA, 24 bp, Homo sapiens
caattctttccatgtaagagccag
